United States Patent
Li et al.

(10) Patent No.: US 11,214,843 B2
(45) Date of Patent: Jan. 4, 2022

(54) COMPOSITIONS, KITS AND METHODS FOR DETECTION OF VIRAL SEQUENCES

(71) Applicant: LIFE TECHNOLOGIES CORPORATION, Carlsbad, CA (US)

(72) Inventors: Kelly Li, San Jose, CA (US); Ioanna Pagani, Oakland, CA (US); Pius Brzoska, Woodside, CA (US); Jisheng Li, Pleasanton, CA (US); Chunling Wang, Redwood City, CA (US); Kathleen Hayashibara, Cupertino, CA (US); Michael Tanner, South San Francisco, CA (US); Hong Ji, Danville, CA (US); Kamini Varma, Saratoga, CA (US); Fangqi Hu, Palo Alto, CA (US); Robert Tebbs, Austin, TX (US)

(73) Assignee: LIFE TECHNOLOGIES CORPORATION, Carlsbad, CA (US)

( * ) Notice: Subject to any disclaimer, the term of this patent is extended or adjusted under 35 U.S.C. 154(b) by 0 days.

(21) Appl. No.: 17/320,659

(22) Filed: May 14, 2021

(65) Prior Publication Data

US 2021/0292857 A1   Sep. 23, 2021

Related U.S. Application Data

(63) Continuation of application No. 17/249,071, filed on Feb. 18, 2021, and a continuation of application No. PCT/US2021/070163, filed on Feb. 18, 2021.

(60) Provisional application No. 63/199,570, filed on Jan. 8, 2021, provisional application No. 63/199,076, filed on Dec. 4, 2020, provisional application No. 63/198,421, filed on Oct. 16, 2020, provisional application No. 63/198,134, filed on Sep. 30, 2020, provisional application No. 62/706,081, filed on Jul. 30, 2020, provisional application No. 63/052,385, filed on Jul. 15, 2020, provisional application No. 63/044,160, filed on Jun. 25, 2020, provisional application No. 62/981,938, filed on Feb. 26, 2020, provisional application No. 62/978,274, filed on Feb. 18, 2020.

(51) Int. Cl.
| | | |
|---|---|---|
| *A23L 33/00* | (2016.01) | |
| *A23L 33/10* | (2016.01) | |
| *A23L 33/105* | (2016.01) | |
| *A61K 31/13* | (2006.01) | |
| *A61K 31/16* | (2006.01) | |
| *C12Q 1/70* | (2006.01) | |

(52) U.S. Cl.
CPC .................... *C12Q 1/701* (2013.01)

(58) Field of Classification Search
CPC ..... A23L 33/10; A23L 33/40; A23V 2002/00; A61K 31/13; A61K 31/16
See application file for complete search history.

(56) References Cited

U.S. PATENT DOCUMENTS

| | | |
|---|---|---|
| 4,889,818 A | 12/1989 | Gelfand et al. |
| 5,079,352 A | 1/1992 | Gelfand et al. |
| 5,210,015 A | 5/1993 | Gelfand et al. |
| 5,436,134 A | 7/1995 | Haugland et al. |
| 5,487,972 A | 1/1996 | Gelfand et al. |
| 5,538,848 A | 7/1996 | Livak et al. |
| 5,618,711 A | 4/1997 | Gelfand et al. |
| 5,658,751 A | 8/1997 | Yue et al. |
| 5,677,152 A | 10/1997 | Birch et al. |
| 5,723,591 A | 3/1998 | Livak et al. |
| 5,773,258 A | 6/1998 | Birch et al. |
| 5,789,224 A | 8/1998 | Gelfand et al. |
| 5,801,155 A | 9/1998 | Kutyavin et al. |
| 5,804,375 A | 9/1998 | Gelfand et al. |
| 5,876,930 A | 3/1999 | Livak et al. |
| 5,994,056 A | 11/1999 | Higuchi |
| 6,030,787 A | 2/2000 | Livak et al. |
| 6,084,102 A | 7/2000 | Kutyavin et al. |
| 6,127,155 A | 10/2000 | Gelfand et al. |
| 6,171,785 B1 | 1/2001 | Higuchi |
| 6,214,979 B1 | 4/2001 | Gelfand et al. |
| 6,258,569 B1 | 7/2001 | Livak et al. |
| 6,486,308 B2 | 11/2002 | Kutyavin et al. |
| 6,814,934 B1 | 11/2004 | Higuchi |
| 6,821,727 B1 | 11/2004 | Livak et al. |
| 7,141,377 B2 | 11/2006 | Gelfand et al. |
| 7,445,900 B2 | 11/2008 | Gelfand et al. |
| 9,194,006 B2 | 11/2015 | Exner et al. |

(Continued)

FOREIGN PATENT DOCUMENTS

| | | |
|---|---|---|
| CN | 103917663 A | 7/2014 |
| CN | 108474030 A | 8/2018 |

(Continued)

OTHER PUBLICATIONS

Corman et al., "Detection of 2019 novel coronavirus (2019-nCoV) by real-time RT-PCR", Eurosurveillance, 2020, 25(3):1-8.*

(Continued)

*Primary Examiner* — Barry A Chestnut
(74) *Attorney, Agent, or Firm* — Jinhee Chang

(57) ABSTRACT

Compositions, assays, methods, diagnostic methods, kits, and diagnostic kits are disclosed for the specific and differential detection of SARS-CoV-2 and/or other viruses from samples, including veterinary samples, clinical samples, food samples, forensic sample, environmental samples (e.g., obtained from soil, garbage, sewage, air, water, food processing and manufacturing surfaces, or likewise), or biological sample obtained from a human or non-human animal.

16 Claims, 17 Drawing Sheets

Specification includes a Sequence Listing.

(56) References Cited

U.S. PATENT DOCUMENTS

| | | |
|---|---|---|
| 9,460,263 B2 | 10/2016 | Holmes et al. |
| 9,464,331 B2 | 10/2016 | Exner et al. |
| 10,619,220 B2 | 4/2020 | Exner et al. |
| 2019/0002963 A1 | 1/2019 | Rajagopal |
| 2019/0144930 A1 | 5/2019 | Bhattacharyya et al. |
| 2020/0291464 A1 | 9/2020 | Bhattacharyya et al. |
| 2020/0340068 A1 | 10/2020 | Exner et al. |

FOREIGN PATENT DOCUMENTS

| | | |
|---|---|---|
| CN | 105624335 B | 8/2019 |
| CN | 111172239 A | 5/2020 |
| CN | 111172327 A | 5/2020 |
| CN | 111206121 A | 5/2020 |
| CN | 111254218 A | 6/2020 |
| CN | 111270013 A | 6/2020 |
| CN | 111304368 A | 6/2020 |
| CN | 111321252 A | 6/2020 |
| CN | 111394431 A | 7/2020 |
| CN | 111394513 A | 7/2020 |
| CN | 111471803 A | 7/2020 |
| CN | 111676325 A | 9/2020 |
| CN | 111733290 A | 10/2020 |
| CN | 111748649 A | 10/2020 |
| CN | 111778362 A | 10/2020 |
| CN | 111808988 A | 10/2020 |
| CN | 111808995 A | 10/2020 |
| CN | 111850166 A | 10/2020 |
| CN | 112063635 A | 12/2020 |
| CN | 112126713 A | 12/2020 |
| EP | 2345738 A1 | 7/2011 |
| EP | 1540009 B1 | 9/2011 |
| EP | 2729581 B1 | 10/2018 |
| JP | 2020080806 A | 6/2020 |
| WO | WO-2020025947 A1 | 2/2020 |
| WO | WO-2020242985 A1 | 12/2020 |

OTHER PUBLICATIONS

Anonymous: "TaqPathTM COVID-19 Combo Kit", Mar. 12, 2020 (Mar. 12, 2020), XP055806624, 14 pages, Retrieved from the Internet: URL: https://www.ibric.org/labox/ref/labox_20200326_2.pdf. [Retrieved on May 21, 2021].

Corman et al., "Detection of 2019 novel coronavirus (2019-nCoV) by real-time RT-PCR", Eurosurveillance, vol. 25, No. 3, Jan. 23, 2020 (Jan. 23, 2020), pp. 1-8, XP055695049, DOI: 10.2807/1560-7917.ES.2020.25.3.2000045.

Huang et al., "RT-LAMP for rapid diagnosis of coronavirus SARS-CoV-2", Microbial Biotechnology, vol. 13, No. 4, Apr. 25, 2020 (Apr. 25, 2020), pp. 950-961, XP055733462, GB, DOI: 10.1111/1751-7915.13586.

Lu R et al., "Genomic characterisation and epidemiology of 2019 novel coronavirus: implications for virus origins and receptor binding", The Lancet, Feb. 22, 2020, vol. 395, No. 10224, pp. 565-574.

PCT/US2021/070163, Search Report and Written Opinion, dated Jun. 9, 2021, 12 pages.

Thermo Fisher Scientific: "TaqMan™ Array Respiratory Tract Microbiota Comprehensive Card", User Guide and Usage Protocol, Catalog No. A41238, Aug. 27, 2019, 3 pages.

WHO Team: "Molecular assays to diagnose COVID-19: Summary table of available protocols", Jan. 24, 2020 (Jan. 24, 2020), XP055732018, 80 pages, Retrieved from the Internet: URL: https://www.who.int/docs/default-source/coronaviruse/whoinhouseassays.pdf?sfvrsn=de3a76aa_2&download=true [retrieved on Sep. 18, 2020].

* cited by examiner

| | Complete genome (%) | Gene region (%) | | | | | | | | | | | |
|---|---|---|---|---|---|---|---|---|---|---|---|---|---|
| Strain | | 1ab | 1a | 1b | S | 3 | E | M | 7 | 8 | 10b | N | 13 | 14 |
| Nucleotide sequences | | | | | | | | | | | | | | |
| Bat-SL-CoVZC45 | 87.6 | 88.9 | 90.7 | 86.0 | 75.2 | 87.8 | 98.7 | 93.4 | 95.2 | 88.8 | 88.5 | 91.1 | 89.1 | 96.7 |
| Bat-SL-CoVZXC21 | 87.5 | 88.7 | 90.3 | 86.1 | 74.7 | 88.9 | 98.7 | 93.4 | 95.2 | 89.1 | 88.5 | 91.2 | 89.5 | 96.7 |
| SARS-CoVGZ02 | 79.0 | 79.5 | 75.4 | 86.3 | 72.7 | 75.6 | 93.5 | 85.1 | 74.5 | 82.1 | :: | 88.1 | :: | :: |
| Amino acid sequences | | | | | | | | | | | | | | |
| Bat-SL-CoVZC45 | :: | 95.6 | 95.6 | 95.8 | 80.2 | 90.9 | 100.0 | 98.6 | 93.4 | 87.6 | 94.2 | 94.3 | 73.2 | 92.9 |
| Bat-SL-CoVZXC21 | :: | 95.2 | 95.1 | 95.5 | 79.6 | 92.0 | 100.0 | 98.6 | 93.4 | 88.4 | 94.2 | 94.3 | 73.2 | 92.9 |
| SARS-CoVGZ02 | :: | 86.2 | 80.5 | 95.6 | 76.2 | 73.1 | 94.7 | 90.1 | 68.9 | 85.2 | :: | 90.3 | :: | :: |

FIG. 1A

COMPOSITIONS, KITS AND METHODS FOR DETECTION OF VIRAL SEQUENCES

CROSS-REFERENCE TO RELATED APPLICATIONS

This application is a continuation of U.S. patent application Ser. No. 17/249,071 filed on Feb. 18, 2021, which claims priority to and the benefit of U.S. Provisional Patent Application Ser. No. 63/199,570, filed Jan. 8, 2021 and titled "COMPOSITIONS, KITS AND METHODS FOR DETECTION OF VIRAL SEQUENCES"; U.S. Provisional Patent Application Ser. No. 63/199,076, filed Dec. 4, 2020 and titled "COMPOSITIONS, KITS AND METHODS FOR DETECTION OF VIRAL SEQUENCES"; U.S. Provisional Patent Application Ser. No. 63/198,421, filed Oct. 16, 2020 and titled "COMPOSITIONS, KITS AND METHODS FOR DETECTION OF VIRAL SEQUENCES"; U.S. Provisional Patent Application Ser. No. 63/198,134, filed Sep. 30, 2020 and titled "COMPOSITIONS, KITS AND METHODS FOR DETECTION OF VIRAL SEQUENCES"; U.S. Provisional Patent Application Ser. No. 62/706,081, filed Jul. 30, 2020 and titled "COMPOSITIONS, KITS AND METHODS FOR DETECTION OF VIRAL SEQUENCES"; U.S. Provisional Patent Application Ser. No. 63/052,385, filed Jul. 15, 2020 and titled "COMPOSITIONS, KITS AND METHODS FOR DETECTION OF VIRAL SEQUENCES"; U.S. Provisional Patent Application Ser. No. 63/044,160, filed Jun. 25, 2020 and titled "COMPOSITIONS, KITS AND METHODS FOR DETECTION OF VIRAL SEQUENCES"; U.S. Provisional Patent Application Ser. No. 62/981,938, filed Feb. 26, 2020 and titled "COMPOSITIONS, KITS AND METHODS FOR DETECTION OF VIRAL SEQUENCES"; and U.S. Provisional Patent Application Ser. No. 62/978,274, filed Feb. 18, 2020 and titled "COMPOSITIONS, KITS AND METHODS FOR DETECTION OF VIRAL SEQUENCES." Also, this application is a continuation of International Application No. PCT/US2021/070163 filed on Feb. 18, 2021, which claims priority to and the benefit of U.S. Provisional Patent Application Ser. No. 63/199,570, filed Jan. 8, 2021 and titled "COMPOSITIONS, KITS AND METHODS FOR DETECTION OF VIRAL SEQUENCES"; U.S. Provisional Patent Application Ser. No. 63/199,076, filed Dec. 4, 2020 and titled "COMPOSITIONS, KITS AND METHODS FOR DETECTION OF VIRAL SEQUENCES"; U.S. Provisional Patent Application Ser. No. 63/198,421, filed Oct. 16, 2020 and titled "COMPOSITIONS, KITS AND METHODS FOR DETECTION OF VIRAL SEQUENCES"; U.S. Provisional Patent Application Ser. No. 63/198,134, filed Sep. 30, 2020 and titled "COMPOSITIONS, KITS AND METHODS FOR DETECTION OF VIRAL SEQUENCES"; U.S. Provisional Patent Application Ser. No. 62/706,081, filed Jul. 30, 2020 and titled "COMPOSITIONS, KITS AND METHODS FOR DETECTION OF VIRAL SEQUENCES"; U.S. Provisional Patent Application Ser. No. 63/052,385, filed Jul. 15, 2020 and titled "COMPOSITIONS, KITS AND METHODS FOR DETECTION OF VIRAL SEQUENCES"; U.S. Provisional Patent Application Ser. No. 63/044,160, filed Jun. 25, 2020 and titled "COMPOSITIONS, KITS AND METHODS FOR DETECTION OF VIRAL SEQUENCES"; U.S. Provisional Patent Application Ser. No. 62/981,938, filed Feb. 26, 2020 and titled "COMPOSITIONS, KITS AND METHODS FOR DETECTION OF VIRAL SEQUENCES"; and U.S. Provisional Patent Application Ser. No. 62/978,274, filed Feb. 18, 2020 and titled "COMPOSITIONS, KITS AND METHODS FOR DETECTION OF VIRAL SEQUENCES." Each of the foregoing applications are incorporated herein by this reference in their entirety.

SEQUENCE LISTING

The instant application contains a Sequence Listing which has been submitted electronically in ASCII format and is hereby incorporated by reference in its entirety. Said ASCII copy, created on May 12, 2021, is named LT01529CON_SL.txt and is 665,718 bytes in size.

FIELD

The present teachings relate to compositions, methods, systems and kits for specific detection, diagnosis and differentiation of viruses involved in infectious diseases. Differential detection of specific viral agents allows accurate diagnosis so that appropriate treatment and infection control measures can be provided in a timely manner.

BACKGROUND

Infectious diseases are caused by pathogenic microbes or infectious agents (e.g., viruses). Early and accurate diagnosis of infectious disease is important for several reasons. For example, proper diagnosis can lead to earlier, more effective treatment which improves outcomes for the infected individual. On the other hand, individuals who are undiagnosed or misdiagnosed may unknowingly transmit diseases to others. Accurate diagnoses also help ensure proper treatments are applied, particularly with respect to certain disease categories with multiple pathogenic causes and similar symptom profiles, such as respiratory diseases.

One example of a problematic virus associated with infectious diseases are coronaviruses. Coronaviruses are a family of viruses having a positive-sense single stranded RNA genome of about 30 kilobases in length. Human coronaviruses were first identified in the mid 1960's as being one of the many etiologic agents of the common cold. People around the world commonly get infected with human coronavirus strains 229E (an alpha coronavirus), NL63 (an alpha coronavirus), OC43 (a beta coronavirus), and HKU1 (a beta coronavirus). These infections present with mild clinical symptoms and are associated with an extremely low mortality rate.

Some coronaviruses infect non-human animals where they can evolve and undergo zoonosis, expanding their tropism to humans. Such crossover events have proven devastating in years past. For example, the Middle East Respiratory Syndrome (MERS) was caused by MERS-CoV, a beta coronavirus that crossed over from dromedary camels to humans. MERS-CoV was associated with a high mortality rate of approximately 35%, but its low transmissibility rate helped to limit its spread and potential for devastation. As another example, Severe Acute Respiratory Syndrome (SARS), which was caused by SARS-CoV, another beta coronavirus, was believed to have been transmitted from bats to civet cats who then transmitted the virus to humans. Although not as deadly as MERS-CoV, SARS-CoV was nevertheless associated with a moderately high mortality rate of approximately 9.6%. Likely due, at least in part, to the lifecycle of SARS-CoV within humans, the spread of this virus was limited mostly to southeast Asian countries. Human infected with SARS-CoV often became symptomatic prior to shedding infectious virions, making quarantining a particularly useful tool for limiting exposure and spread of the infection.

More recently, a new variant beta coronavirus, SARS-CoV-2 (also known as 2019-nCoV), has emerged, potentially from a crossover event between pangolins and humans in Wuhan, China. While the epidemiological data are incomplete, reports so far indicate that over 85 million people worldwide are believed to have already been infected by SARS-CoV-2. However, unlike MERS-CoV and SARS-CoV before it, SARS-CoV-2 appears to be significantly less lethal on average with a mortality rate of about 2.3%. Due to its increased transmissibility, the seemingly small percentage of deaths associated with SARS-CoV-2 belies its worldwide impact, having caused an estimated 1.9 million deaths in the worldwide pandemic at the time of this filing, and currently continuing to grow. The raw number of humans impacted by SARS-CoV-2 dwarfs the total number of deaths caused by MERS-CoV and SARS-CoV combined—reportedly around 1,600.

Given the present and continuing emergence of new coronavirus strains, there is an urgent need to develop methods for the rapid detection and characterization of existing and novel coronavirus strains so that appropriate treatment and infection control measures can be properly instituted in a timely manner. Problematically, many of the SARS-CoV-2 detection assays are non-specific with respect to detecting and differentiating SARS-CoV-2 from other respiratory pathogens, particularly other coronaviruses, which has led to a lack of patient confidence in the diagnostic potential of current SARS-CoV-2 detection assays. Further, because individuals infected with SARS-CoV-2 often experience symptoms similar to those infected with Influenza Types A or B (Flu A or Flu B) and/or Respiratory Syncytial Virus (RSV), there is an additional need to be able to simultaneously test for each of these respiratory viruses in order to provide an accurate diagnosis before seeking/providing treatment and/or confining the individual to a quarantined area under the potentially mistaken belief that they are infected with SARS-CoV-2. Each misidentified or misdiagnosed instance of SARS-CoV-2 infection further convolutes the epidemiological data and prevents the implementation of appropriate, informed solutions.

Accordingly, there are a number of disadvantages with current methods, systems, compositions, and kits for detecting existing and novel coronavirus strains among other common respiratory tract viral pathogens, which can be addressed, and the methods, systems, compositions, and kits of the present disclosure address and overcome at least some of the foregoing problems in the art.

BRIEF DESCRIPTION OF THE DRAWINGS

In order to describe the manner in which the above recited and other advantages and features of the disclosure can be obtained, a more particular description of the disclosure briefly described above will be rendered by reference to specific embodiments thereof, which are illustrated in the appended drawings. It is appreciated that these drawings depict only typical embodiments of the disclosure and are not therefore to be considered to be limiting of its scope. The disclosure will be described and explained with additional specificity and detail through the use of the accompanying drawings in which:

FIG. 1A illustrates the sequence identity between the consensus SARS-CoV-2 sequence and three closely related coronaviruses, namely, Bat-SL-CoVZC45, Bat-SL-CoVZXC21, and SARS-CoVGZ02, across the complete genome and across specific gene regions within the coronavirus genome.

DETAILED DESCRIPTION

Figure 1B:
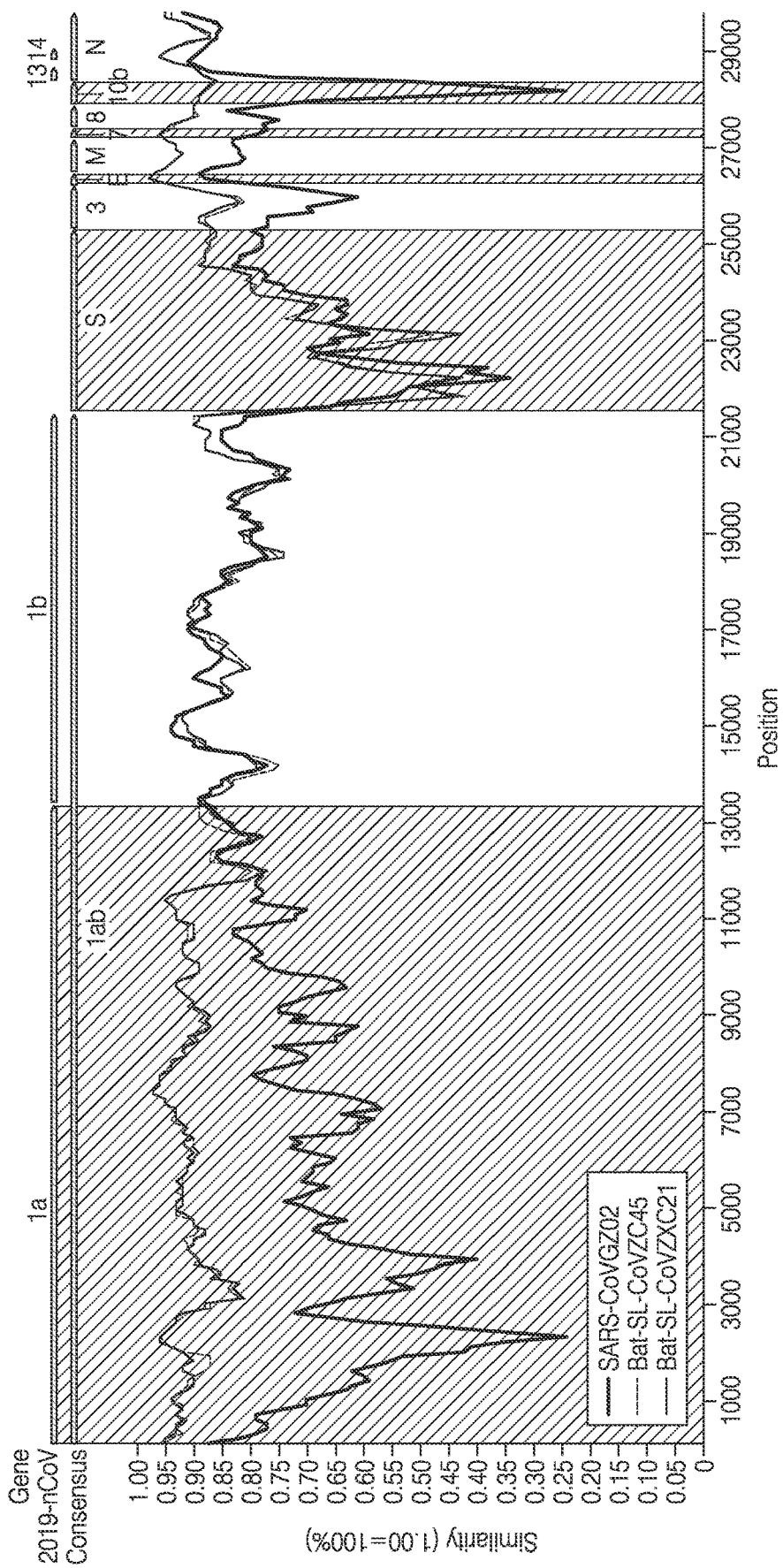
FIG. 1B illustrates the tabular information of FIG. 1A in graphical form with the x-axis being the base pair position within the viral genome and the y-axis being the percent similarity of each related virus to the corresponding SARS-CoV-2 consensus sequence.

Before describing various embodiments of the present disclosure in detail, it is to be understood that this disclosure is not limited to the parameters of the particularly exemplified systems, methods, apparatus, products, processes, and/or kits, which may, of course, vary. Thus, while certain embodiments of the present disclosure will be described in detail, with reference to specific configurations, parameters, components, elements, etc., the descriptions are illustrative and are not to be construed as limiting the scope of the claimed invention. In addition, the terminology used herein is for the purpose of describing the embodiments and is not necessarily intended to limit the scope of the claimed invention.

Furthermore, it is understood that for any given component or embodiment described herein, any of the possible candidates or alternatives listed for that component may generally be used individually or in combination with one another, unless implicitly or explicitly understood or stated otherwise. Additionally, it will be understood that any list of such candidates or alternatives is merely illustrative, not limiting, unless implicitly or explicitly understood or stated otherwise.

In addition, unless otherwise indicated, numbers expressing quantities, constituents, distances, or other measurements used in the specification and claims are to be understood as being modified by the term "about," as that term is defined herein. Accordingly, unless indicated to the contrary, the numerical parameters set forth in the specification and attached claims are approximations that may vary depending upon the desired properties sought to be obtained by the subject matter presented herein. At the very least, and not as an attempt to limit the application of the doctrine of equivalents to the scope of the claims, each numerical parameter should at least be construed in light of the number of reported significant digits and by applying ordinary rounding techniques. Notwithstanding that the numerical ranges and parameters setting forth the broad scope of the subject matter presented herein are approximations, the numerical values set forth in the specific examples are reported as precisely as possible. Any numerical values, however, inherently contain certain errors necessarily resulting from the standard deviation found in their respective testing measurements.

All publications and patent applications cited herein, as well as the Appendices attached hereto, are incorporated by reference in their entirety for all purposes to the same extent as if each were specifically and individually indicated to be so incorporated by reference. Although the present invention has been described in some detail by way of illustration and example for purposes of clarity and understanding, it will be apparent that certain changes and modifications may be practiced within the scope of the spirit and substance of this disclosure and of the appended claims.

Any headings and subheadings used herein are for organizational purposes only and are not meant to be used to limit the scope of the description or the claims.

Overview of Compositions, Systems, and Kits for Detection of Target Sequences

As discussed above, a new variant beta coronavirus, SARS-CoV-2 (also known as 2019-nCoV), has recently emerged as the newest pandemic virus. Current epidemiological data is potentially disadvantaged in view of existing non-specific detection assays used to identify SARS-CoV-2 infections. The lack of a reliable assay for accurately and specifically identifying SARS-CoV-2 from a sample (e.g., a clinical sample obtained from nasopharyngeal swab, nasopharyngeal aspirate, bronchoalveolar lavage, buccal swab, saliva, or urine) and/or differentiating this virus from other common respiratory pathogens may prevent healthcare professionals from properly treating and advising patients. Further, by not being able to accurately and quickly identify individuals infected with SARS-CoV-2, it can be quite difficult to establish a systematic treatment campaign or implement successful preventative measures.

Given the present and continuing emergence of new coronavirus strains, there is an urgent need to develop methods for the rapid detection and characterization of existing and novel coronavirus strains so that appropriate treatment and infection control measures can be properly instituted in a timely manner. Problematically, many of the available SARS-CoV-2 detection assays are non-specific with respect to detecting and differentiating SARS-CoV-2 from other respiratory pathogens, particularly other coronaviruses, which has potential to lead to a lack of patient confidence in the diagnostic potential of current SARS-CoV-2 detection assays. Further, because individuals infected with SARS-CoV-2 often experience symptoms similar to those infected with Influenza Types A or B and/or Respiratory Syncytial Virus (RSV), and/or other respiratory microbes, there is an additional need to be able to simultaneously test for each of these respiratory infectious agents in order to provide an accurate diagnosis before seeking/providing treatment and/or confining the individual to a quarantined area under the potentially mistaken belief that they are infected with SARS-CoV-2. Each misidentified or misdiagnosed instance of SARS-CoV-2 infection can further convolute the epidemiological data and prevent the implementation of appropriate, informed solutions that may help reign in the pandemic.

A number of assays are available for allegedly detecting the presence of SARS-CoV-2, such as those provided by the United States Centers for Disease Control and Prevention (US-CDC) that contain probes targeting the N protein, the assay developed by the Chinese CDC targeting the coding regions of the N protein and the ORF1ab protein, and the WHO kit targeting the coding regions of the N protein, the E protein, and the closely related RdRp SARS/Wuhan coronavirus. While each of the foregoing assays have 100% coverage of all published SARS-CoV-2 genomes to date—meaning these assays are each theoretically capable of identifying the presence of SARS-CoV-2 from a nucleic acid sample—the design of these assays is such that the detection is non-specific, which can perpetuate the issues discussed above instead of alleviating them.

For example, the probes used in the WHO kit for the E and N proteins map perfectly to hundreds of non-SARS-CoV-2 coronavirus strains. Furthermore, the confirmatory probe identifying RdRp-SARS/Wuhan was designed to detect both SARS and SARS-CoV-2, making it non-specific by design. These assays lack endogenous controls as well. In total, this assay is non-specific for SARS-CoV-2 and is prone to providing false positive results. Similarly, the US-CDC kit for detecting SARS-CoV-2 has also exhibited some non-specificity. It relies on three separate probes to the coding region of the N protein, and two of these probes can generate a false positive signal in the presence of non-SARS-CoV-2 coronaviruses, such as many SARS strains and even the bat-SARS-CoV strain, particularly when present in higher concentrations. Accordingly, even this kit fails to provide an assay having the desired SARS-CoV-2 specificity, and there remains an unmet need in the market for a SARS-CoV-2 detection assay that is accurate and specific and that, preferably, can be implemented quickly with a short turnaround time between obtaining the sample and receiving the results.

Disclosed herein are compositions, kits, and methods for specifically detecting viral sequences, in particular SARS-CoV-2. Additional compositions, kits, and methods are disclosed that enable the detection and differentiation of SARS-CoV-2 from other related coronaviruses, from respiratory tract microbiota, and from common respiratory pathogens that produce similar symptomatic infections in humans, including Influenza Type A (Flu A), Influenza Type B (Flu B), and Respiratory Syncytial Virus (e.g., RSV A and RSV B). As demonstrated throughout the present description, many of the probes disclosed herein include nucleic acid binding portions that exhibit 100% identity (i.e., no mismatches) to all 52 genomic sequences of SARS-CoV-2 reported in the literature. Further, the kits and methods provided herein specifically target all 71 complete genomes currently available at GISAID, and do not target any of the 2,116 complete genomes of other coronaviruses currently available at NCBI, underscoring the beneficial specificity of the disclosed methods and kits for detecting SARS-CoV-2. Indeed, the disclosed embodiments solve at least some of the unmet needs in the field of viral identification and provide meaningful improvements over prior viral detection compositions, kits, and methods.

In some embodiments, the strain coverage for the compositions, kits, and methods described herein for detecting SARS-CoV-2, including those with primers and probes selected from SEQ ID NO:4-SEQ ID NO:2533, is 99.9% based on an in silico analysis of 35,833 high quality complete sequences available from GISAID as of Jul. 6, 2020. Additionally, the compositions, kits, and methods disclosed herein for the detection of viral sequences, particularly those multiplex assays for identifying the specific presence of SARS-CoV-2, Flu A, Flu B, RSV A, and/or RSV B using primers and probes selected from SEQ ID NO:4-SEQ ID NO:2533, retain the 99.9% specificity and precision for identifying SARS-CoV-2 strains, and the strain coverage is 98.2% (6730/6854) for Flu A and 99.3% (3105/3127) for Flu B, based on data available from NCBI as of Apr. 13, 2020.

SEQ ID NO:4-SEQ ID NO:257 includes a list of sequences which are amenable for use as forward primers targeting the ORF1ab, S protein, or N protein coding regions of the SARS-CoV-2 genome, regions of the human influenza (Flu) type A or type B viral genome, regions of the Respiratory Syncytial Virus (RSV) type A or type B viral genome, or control sequences, such as MS2 Phage and RNase P.

SEQ ID NO:267-SEQ ID NO:510 includes a list of sequences which are amenable for use as reverse primers targeting the ORF1ab, S protein, or N protein coding regions of the SARS-CoV-2 genome, regions of the human influenza (Flu) type A or type B viral genome, regions of the Respiratory Syncytial Virus (RSV) type A or type B viral genome, or control sequences, such as MS2 Phage and RNase P.

SEQ ID NO:520-SEQ ID NO:2533 includes a list of sequences which are nucleic acid portions of probes targeting the ORF1ab, S protein, or N protein coding regions of the SARS-CoV-2 genome, regions of the human influenza (Flu) type A or type B viral genome, regions of the Respiratory Syncytial Virus (RSV) type A or type B viral genome, or control sequences, such as MS2 Phage and RNase P.

Further, because SARS-CoV-2 is an RNA virus, it can mutate with relatively high frequency, making it difficult to consistently detect over time. Specific detection can be ensured even in the case of future variants by using multiple assays targeting different regions of the same target genes to ensure redundancy and specificity. Unlike other published assay designs, which require multiple assay designs and separate reactions for each loci to enhance specificity, the disclosed primers and probes can differentiate SARS-CoV-2 strains using a single and specific assay conducted in a single, or at the most two, reaction volumes.

The embodiments of the present disclosure beneficially provide improved compositions, kits, and methods for detecting and differentiating viral respiratory tract pathogens that share similar symptomatic presentations in humans. As such, these disclosed embodiments advantageously improve the efficiency and accuracy of evaluating respiratory samples (e.g., in a laboratory setting, at point of sale location, and/or at point of care location) for the presence of viral sequences and can improve the diagnosis and treatment of affected individuals.

The disclosed compositions, kits, and methods for the detection of viral sequences can also improve the accuracy of epidemiological studies related to SARS-CoV-2, Flu A, Flu B, and/or RSV infections. Additional embodiments disclosed herein include assay panels (e.g. in the format of an array card) for determining the presence of viral, bacterial, and fungal nucleic acid sequences that can, among other things, improve syndromic evaluations and epidemiological studies by being able to detect and differentiate SARS-CoV-2 from related coronaviruses, influenza viruses, rhinoviruses, adenoviruses, and other viral, bacterial, and fungal microbes.

Sample Collection

The disclosed compositions, kits, and methods are configured to detect viral nucleic acid from a sample, preferably a specific and differential detection of SARS-CoV-2 from a sample. The sample may be a veterinary sample (e.g., from non-human animals like mink), a clinical sample (e.g., from a symptomatic or asymptomatic human), a food sample, a forensic sample, an environmental sample (e.g., soil, dirt, garbage, sewage, air, or water), including food processing and manufacturing surfaces, or any other biological sample. In most instances, SARS-CoV-2 or other coronaviruses and respiratory tract pathogens are detected by analysis of swabs or fluid obtained from swabs, such as throat swabs, nasal swabs, nasopharyngeal swabs, nasal mid-turbinate swabs, oropharyngeal swabs, cheek swabs, saliva swabs, or other swabs, though it should be appreciated that SARS-CoV-2 or other coronaviruses and/or respiratory tract pathogens may also be detected by analysis of urine samples, saliva samples, or other clinical samples.

The sample can be collected by a healthcare professional in a healthcare setting, but in some instances, the sample may also be collected by the subject themselves or by an individual assisting the subject in self-collection. For example, a nasopharyngeal swab has heretofore served as the gold standard for obtaining a sample to be used in clinical diagnostics or screening. Such swabs are often used by a healthcare professional in a healthcare setting. Other samples, such as a saliva sample, can similarly be obtained in a healthcare setting with the assistance or oversight of a healthcare professional. However, in some instances, self-collection of a sample can be more efficient and can be done outside of a healthcare setting.

In some embodiments, the sample is a raw saliva sample collected—whether by self-collection or assisted/supervised collection—in a sterile tube or specifically-designed saliva collection device. The saliva collection tube/device may be a component of a self-collection kit having instructions for use, such as sample collection instructions, sample preparation or storage instructions, and/or shipping instructions. In some embodiments, the raw saliva sample can be collected directly into a sealable container without any preservation solution or other fluid or substance in the container prior to receipt of the saliva sample within the container or as a result of closing/sealing the container. In some other embodiments, the raw saliva sample is collected into a container which already contains some amount of a preservation or treatment solution or other fluid or substance.

Traditionally, a nucleic acid fraction of the sample is extracted or purified from the sample—whether obtained via swab, from raw saliva, or other bodily fluid—prior to any detection of viral nucleic acids therein. Surprisingly, the disclosed embodiments for detecting viral nucleic acid from a sample can be adapted to detect viral nucleic acid directly from a raw saliva sample without a specific nucleic acid purification and/or extraction step prior to its use in downstream detection assays (e.g., RT-qPCR). In some embodiments, the saliva sample is pre-treated prior to use (see, for example, Example 8 herein). This can include, for example, heating the saliva sample, such as by placing the raw saliva sample on a heat block/water bath set to a temperature of 95° C. for 30 minutes, followed by combining the heat-treated saliva with a buffer or lysis solution. The buffer or lysis solution can include, for example, any nucleic-acid-amenable buffer such as TBE and may further include a detergent and/or emulsifier such as Triton-X-100, NP-40, or the polysorbate-type nonionic surfactant, Tween-20.

It should be appreciated that in some embodiments, the disclosed compositions can include the sample mixed with a buffer and detergent/emulsifier. The sample can be added to a buffer/detergent mixture or vice versa. As a non-limiting example, a set of subject samples can be prepared as compositions for downstream analysis and detection of viral sequence by adding a volume of heat-treated sample for each subject into one (or a plurality) of wells in a multi-well plate. A volume of a buffer/detergent mixture (e.g., TBE+ Tween-20) can then be added to each well containing a subject sample. Alternatively, a multi-well plate can be loaded with a volume of a buffer/detergent mixture into which a volume of heat-treated saliva is added. Once combined, this probative template solution can be used immediately or stored for later analysis. Such probative template solutions can also be combined with PCR reagents (e.g., buffers, dNTPs, master mixes, etc.) prior to or after storage.

Compositions, Kits, and Methods for Detection of SARS-CoV-2 Viral Sequences

The primers and probes disclosed herein are useful for the detection of SARS-CoV-2 from a sample, such as a biological sample obtained from a human or non-human (e.g., mink) subject. Such primers and/or probes can be used within a kit for performing a nucleic-acid-based assay for the detection and identification of one or more target nucleic acids in the sample, which may be single stranded or double stranded of any size. For example, the primers and probes provided in SEQ ID NO:4-SEQ ID NO:2533 can be used to amplify and/or analyze one or more specific target sequences present in the SARS-CoV-2 viral genome or within one or more of the Flu A, Flu B, RSV A, RSV B, other target respiratory microbes and/or controls (see, e.g., Tables 3A and 3B), as described herein. The amplified products ("amplicons") can be detected and/or analyzed using any suitable method and on any suitable platform.

Polymerase chain reaction (PCR) and related methods are common methods of nucleic acid amplification. PCR is one, but not the only, example of a nucleic acid polymerase reaction method for amplifying a nucleic acid test sample comprising the use of a known nucleic acid as a primer and a nucleic acid polymerase to amplify or generate a specific target nucleic acid. In general, PCR utilizes a primer pair that consists of a forward primer and a reverse primer configured to amplify a target segment of a nucleic acid template. Typically, but not always, the forward primer hybridizes to the 5' end of the target sequence and the reverse primer will be identical to a sequence present at the 3' end of the target sequence. The reverse primer will typically hybridize to a complement of the target sequence, for example an extension product of the forward primer and/or vice versa. PCR methods are typically performed at multiple different temperatures, causing repeated temperature changes during the PCR reaction ("thermal cycling"). Other amplification methods, such as, e.g., loop-mediated isothermal amplification ("LAMP"), and other isothermal methods, such as those listed in Table 1, may require less or less extensive thermal cycling than does PCR, or require no thermal cycling. Such isothermal amplification methods are also contemplated for use with the assay compositions, reaction mixtures, kits described herein.

TABLE 1

Summary of optional isothermal amplification methods.

| | |
|---|---|
| NASBA | Nucleic acid sequence-based amplification (NASBA) is a method used to amplify RNA. |
| LAMP | Loop-mediated isothermal amplification (LAMP) is a single tube technique for the amplification of DNA. It typically uses 4-6 primers, which form loop structures to facilitate subsequent rounds of amplification. |
| HDA | Helicase-dependent amplification (HDA) uses the double-stranded DNA unwinding activity of a helicase to separate strands for in vitro DNA amplification at constant temperature. |
| RCA | Rolling circle amplification (RCA) starts from a circular DNA template and a short DNA or RNA primer to form a long single stranded molecule. |
| MDA | Multiple displacement amplification (MDA) is a technique that initiates when multiple random primers anneal to the DNA template and the polymerase amplifies DNA at constant temperature. |
| WGA | When MDA is used to amplify DNA from a whole genome of a cell it is called whole genome amplification (WGA). (Other methods of WGA include MALBAC, LIANTI, DOP-PCR.) |
| RPA | Recombinase polymerase amplification (RPA) is a low temperature DNA and RNA amplification technique. |

Methods of performing PCR, including those in Table 1, are well known in the art; nevertheless, further discussion of PCR and other methods may be found, for example, in Molecular Cloning: A Laboratory Manual by Green and Sambrook, Cold Spring Harbor Laboratory Press, 4th Edition 2012, which is incorporated by reference herein in its entirety.

SARS-CoV-2 has a single-stranded positive-sense RNA genome. Other viruses, such as Flu A, Flu B, RSV A, and RSV B also have RNA-based genomes. In some embodiments, therefore, the amplification reaction (e.g., LAMP or PCR) can be combined with a reverse transcription (RT) reaction, such as in RT-LAMP or RT-PCR to convert the RNA genome to a cDNA template. The cDNA template is then used to create amplicons of the target sequences in the subsequent amplification reactions.

In some embodiments, the amplifying step can include performing qPCR, as that term is defined herein. qPCR is a sensitive and specific method for detecting and optionally quantifying amounts of starting nucleic acid template (e.g., coronaviral nucleic acid) in a sample. Methods of qPCR are well known in the art; one leading method involves the use of a specific hydrolysis probe in conjunction with a primer pair. The hydrolysis probe can include a detectable label (e.g., fluorophore) at one end and a quencher that quenches the detectable label at the other end. In some embodiments, the label is at the 5' end of the probe and cleavage of the 5' label occurs via 5' hydrolysis of the probe by the nucleic acid polymerase as it extends the forward primer towards the probe binding site within the target sequence. The separation of the probe label from the probe quencher via cleavage (or unfolding) of the probe results in an increase in signal which can be detected and optionally quantified. The detectable signal can be monitored over time and analyzed to determine the relative or absolute amount of starting nucleic acid template present in the sample. Suitable labels are described herein. In some embodiments, the dye-quencher combinations are used, such as those described in the Examples. It should be appreciated that qPCR and RT-qPCR methods are known to those having skill in the art. Nevertheless, particular embodiments are provided in the Examples and provide further details regarding qPCR as well as related compositions and methods of use thereof.

The reaction vessel or volume can optionally include a tube, channel, well, cavity, site or feature on a surface, or alternatively a droplet (e.g., a microdroplet or nanodroplet) that may be deposited onto a surface or into a surface well or cavity or suspended within (or partially bounded by) a fluid stream. In some embodiments, the reaction volume includes one or more droplets arrayed on a surface or present in an emulsion. The reaction volumes can optionally be formed by fusion of multiple pre-reaction volumes containing different components of an amplification reaction. For example, pre-reaction volumes containing one or more primers can be fused with pre-reaction volumes containing human nucleic acid samples and/or polymerase enzymes, nucleotides, and buffer. In some embodiments involving performing qPCR reactions in array format, a surface contains multiple grooves, channels, wells, cavities, sites, or features defining a reaction volume containing one or more amplification reagents (e.g., primers, probes, buffer, polymerase, nucleotides, and the like). In some array-formatted singleplex embodiments, the reaction volume within the selected tubes, grooves, channels, wells, cavities, sites, or features contains only a single forward primer sequence and a single reverse primer sequence. Optionally, a probe sequence is also included in the singleplex reaction volume.

In some array-formatted multiplex embodiments, the reaction volume within the selected tubes, grooves, channels, wells, cavities, sites, or features contains multiple (e.g., 2, 3, 4, 5, 6, etc.) forward primer sequences and multiple reverse primer sequences. Optionally, one or more probe sequences is also included in the multiplex reaction volume.

For instance, exemplary methods for polymerizing and/or amplifying and detecting nucleic acids suitable for use as described herein are commercially available as TaqMan assays (see, e.g., U.S. Pat. Nos. 4,889,818; 5,079,352; 5,210,015; 5,436,134; 5,487,972; 5,658,751; 5,210,015; 5,487,972; 5,538,848; 5,618,711; 5,677,152; 5,723,591; 5,773,258; 5,789,224; 5,801,155; 5,804,375; 5,876,930; 5,994,056; 6,030,787; 6,084,102; 6,127,155; 6,171,785; 6,214,979; 6,258,569; 6,814,934; 6,821,727; 7,141,377; and/or 7,445,900, all of which are hereby incorporated herein by reference in their entirety). TaqMan assays are typically carried out by performing nucleic acid amplification on a target polynucleotide using a nucleic acid polymerase having 5'-to-3' nuclease activity, a primer capable of hybridizing to the target polynucleotide, and an oligonucleotide probe capable of hybridizing to said target polynucleotide 3' relative to the primer. The oligonucleotide probe typically includes a detectable label (e.g., a fluorescent reporter molecule) and a quencher molecule capable of quenching the fluorescence of the reporter molecule. Typically, the detectable label and quencher molecule are part of a single probe. As amplification proceeds, the polymerase digests the probe to separate the detectable label from the quencher molecule. The detectable label is monitored during the reaction, where detection of the label corresponds to the occurrence of nucleic acid amplification (e.g., the higher the signal the greater the amount of amplification). Variations of TaqMan assays are known in the art and would be suitable for use in the methods described herein.

For example, a singleplex or multiplex qPCR can include a single TaqMan dye associated with a locus-specific primer or multiple TaqMan dyes respectively associated with a plurality of loci in a multiplex format. As a non-limiting example, a 4-plex reaction can include FAM (emission peak ~517 nm), VIC (emission peak ~551 nm), ABY (emission peak ~580 nm), and JUN (emission peak ~617 nm) dyes, each dye being associated with a different target sequence and each dye being quenched by QSY, can allow up to 4 targets to be amplified and tracked real-time within a single reaction vessel. These aforementioned reporter dyes are optimized to work together with minimal spectral overlap for improved performance. These dyes can additionally be combined with Mustang Purple (emission peak ~654 nm) for use monitoring fluorescence of a control or for use in a non-emission-spectrum-overlapping 5-plex assay. In addition, the QSY quencher is fully compatible with probes that have minor-groove binder quenchers.

Detector probes may be associated with alternative quenchers, including without limitation, dark fluorescent quencher (DFQ), black hole quenchers (BHQ), Iowa Black, QSY quencher, and Dabsyl and Dabcel sulfonate/carboxylate Quenchers. Detector probes may also include two probes, wherein, for example, a fluorophore is associated with one probe and a quencher is associated with a complementary probe such that hybridization of the two probes on a target quenches the fluorescent signal or hybridization on the target alters the signal signature via a change in fluorescence. Detector probes may also include sulfonate derivatives of fluorescein dyes with $SO_3$ instead of the carboxylate group, phosphoramidite forms of fluorescein, phosphoramidite forms of Cy5.

It should be appreciated that when using more than one detectable label, particularly in a multiplex format, each detectable label should differ in its spectral properties from the other detectable labels used therewith such that the labels may be distinguished from each other, or such that together the detectable labels emit a signal that is not emitted by either detectable label alone. Exemplary detectable labels include, for instance, a fluorescent dye or fluorophore (e.g., a chemical group that can be excited by light to emit fluorescence or phosphorescence), "acceptor dyes" capable of quenching a fluorescent signal from a fluorescent donor dye, and the like, as described above. Suitable detectable labels may include, for example, fluoresceins (e.g., 5-carboxy-2,7-dichlorofluorescein; 5-Carboxyfluorescein (5-FAM); 5-Hydroxy Tryptamine (5-HAT); 6-JOE; 6-carboxyfluorescein (6-FAM); Mustang Purple, VIC, ABY, JUN; FITC; 6-carboxy-4',5'-dichloro-2',7'-dimethoxy-fluorescein (JOE)); 6-carboxy-1,4-dichloro-2',7'-dichloro-fluorescein (TET); 6-carboxy-1,4-dichloro-2',4',5',7'-tetra-chlorofluorescein (HEX); Alexa Fluor fluorophores (e.g., 350, 405, 430, 488, 500, 514, 532, 546, 555, 568, 594, 610, 633, 635, 647, 660, 680, 700, 750); BODIPY fluorophores (e.g., 492/515, 493/503, 500/510, 505/515, 530/550, 542/563, 558/568, 564/570, 576/589, 581/591, 630/650-X, 650/665-

X, 665/676, FL, FL ATP, Fl-Ceramide, R6G SE, TMR, TMR-X conjugate, TMR-X, SE, TR, TR ATP, TR-X SE), Cascade Blue, Cascade Yellow; Cy™ dyes (e.g., 3, 3.18, 3.5, 5, 5.18, 5.5, 7), cyan GFP, cyclic AMP Fluorosensor (Fi-CRhR), fluorescent proteins (e.g., green fluorescent protein (e.g., GFP. EGFP), blue fluorescent protein (e.g., BFP, EBFP, EBFP2, Azurite, mKalama1), cyan fluorescent protein (e.g., ECFP, Cerulean, CyPet), yellow fluorescent protein (e.g., YFP, Citrine, Venus, YPet), FRET donor/acceptor pairs (e.g., fluorescein/fluorescein, fluorescein/tetramethylrhodamine, IAEDANS/fluorescein, EDANS/dabcyl, BODIPY FL/BODIPY FL, Fluorescein/QSY7 and QSY9), LysoTracker and LysoSensor (e.g., LysoTracker Blue DND-22, LysoTracker Blue-White DPX, LysoTracker Yellow HCK-123, LysoTracker Green DND-26, LysoTracker Red DND-99, LysoSensor Blue DND-167, LysoSensor Green DND-189, LysoSensor Green DND-153, LysoSensor Yellow/Blue DND-160, LysoSensor Yellow/Blue 10,000 MW dextran), Oregon Green (e.g., 488, 488-X, 500, 514); rhodamines (e.g., 110, 123, B, B 200, BB, BG, B extra, 5-carboxytetramethylrhodamine (5-TAMRA), 5 GLD, 6-Carboxyrhodamine 6G, Lissamine, Lissamine Rhodamine B, Phallicidine, Phalloidine, Red, Rhod-2, ROX (6-carboxy-X-rhodamine), 5-ROX (carboxy-X-rhodamine), Sulphorhodamine B can C, Sulphorhodamine G Extra, TAMRA (6-carboxytetramethyl¬rhodamine), Tetramethylrhodamine (TRITC), WT), Texas Red, Texas Red-X, among others as would be known to those of skill in the art.

Other detectable labels may also be used. For example, primers can be labeled and used to both generate amplicons and to detect the presence (or concentration) of amplicons generated in the reaction, and such may be used in addition to or as an alternative to labeled probes described herein. As a further example, primers may be labeled and utilized as described in Nazarenko et al. (Nucleic Acids Res. 2002 May 1; 30 (9): e37), Hayashi et al. (Nucleic Acids Res. 1989 May 11; 17(9): 3605), and/or Neilan et al. (Nucleic Acids Res. Vol. 25, Issue 14, 1 Jul. 1997, pp. 2938-39). Those of skill in the art will also understand and be capable of utilizing the PCR processes (and associated probe and primer design techniques) described in Zhu et al. (Biotechniques. 2020 July: 10.2144/btn-2020-0057).

In some embodiments, intercalating labels can be used such as ethidium bromide, SYBR Green I, SYBR GreenER, and PicoGreen (Life Technologies Corp., Carlsbad, Calif.), thereby allowing visualization in real-time, or end point, of an amplification product in the absence of a detector probe. It should be appreciated, however, that use of intercalating labels may limit multiplexing capabilities, as many intercalating labels are non-specific for a given sequence and merely report the total (or proportional) nucleic acid content within a reaction. In some embodiments, real-time visualization may include both an intercalating detector probe and a sequence-based detector probe. The detector probe can be at least partially quenched when not hybridized to a complementary sequence in the amplification reaction and is at least partially unquenched when hybridized to a complementary sequence in the amplification reaction. In some embodiments, probes may further comprise various modifications such as a minor groove binder to further provide desirable thermodynamic characteristics.

The genetic sequence of SARS-CoV-2 is available as NCBI accession no. NC_045512.2 and as GenBank accession no. MN908947.3, describing a positive-sense, single-stranded RNA genome of 29,844 base pairs; occasionally, such sequence is referred to herein as the 'normal', 'wild type' or 'reference' sequence for SARS-CoV-2, as opposed to SARS-CoV-2 variant or mutant sequences. Initial genetic characterizations of SARS-CoV-2 identified three coronaviruses having close homology to SARS-CoV-2, namely Bat-SL-CoVZC45, Bat-SL-CoVZXC21, and SARS-CoVGZ02. The sequence identity between these strains is depicted in FIGS. 1A and 1B. In particular, FIG. 1A illustrates the sequence identity between the consensus SARS-CoV-2 sequence as compared to each of Bat-SL-CoVZC45, Bat-SL-CoVZXC21, and SARS-CoVGZ02, across the complete genome as well as across each specific gene region within the coronavirus genome. FIG. 1B illustrates the tabular information of FIG. 1A in graphical form with the x-axis being the base pair position within the viral genome and the y-axis being the percent similarity of each related virus to the corresponding SARS-CoV-2 consensus sequence.

The analysis illustrated in FIGS. 1A and 1B identified at least three genetic regions with significant variability between SARS-CoV-2 and the other related viruses, specifically within the viral genes encoding the ORF1ab protein (SEQ ID NO:1; base pair 1 corresponds to base pair 1000 of MN908947.3), the S protein (SEQ ID NO:2; base pair 1 corresponds to base pair 21564 of MN908947.3), and the N protein (SEQ ID NO:3; base pair 1 corresponds to base pair 28275 of MN908947.3). The region comprising the coding sequence for the ORF1ab protein is between base pairs 1000-3000 of the SARS-CoV-2 genome; this sequence corresponds to SEQ ID NO:1. The 2,000 base pair region of the SARS-CoV-2 genome that includes the coding sequence for the S protein is between base pairs 21,564-23,564; this sequence corresponds to SEQ ID NO:2. Finally, the 1,283 base pair region of the SARS-CoV-2 genome that includes the coding sequence for the N protein is between base pairs 28,275-29,558; this sequence corresponds to SEQ ID NO:3.

In some embodiments, detecting amplification of target sequences includes measuring one or more signals emitted by a detectable label attached to, or associated with, one or more primers or probes. Optionally, the one or more signals are measured multiple times as the amplification reaction progresses, in some embodiments at least once per thermal cycle (e.g. during or just after an annealing or extension phase of a thermal cycle), thus allowing for amplification to be detected in 'real time'. In 'multiplex' amplification embodiments, the formation of a plurality of separate and different amplification products can be tracked over time by measuring a signal in one or more detection channels. The signal can be emitted by a detectable label, optionally a fluorescent label, attached to a primer and/or probe that selectively hybridizes to the amplification product. In some embodiments, each channel is calibrated to preferentially or selectively detect a corresponding amplification product and the signal in each channel is used as a measure of concentration of the corresponding amplification product. For example, in some embodiments, an amplification product of the S gene from SARS-CoV-2 is detected in a first detection channel based on a first signal emitted by a first label attached to, or associated with, a first primer and/or first probe that selectively hybridizes to the S gene amplification product, and an amplification product of the N gene is detected in a second detection channel based on a second signal emitted by a second label attached to, or associated with, a second primer and/or second probe that selectively hybridizes to the N gene amplification product. Optionally, in 'triplex' embodiments involving amplification of the Orf1ab gene, the amplification product of the ORF1ab gene is detected in a third channel based on a third signal emitted by a third label attached to a third primer and/or third probe that selectively hybridizes to the ORF1ab amplification product or to the ORF1ab target region. In some embodiments, the amplification product of a control or reference sequence is detected in a fourth channel based on a fourth signal emitted by a fourth label attached to a fourth primer and/or fourth probe that selectively hybridizes to an amplification product of, or to a target sequence within the control or reference sequence.

In some embodiments (e.g., in the well-known and widely used TaqMan™ line of qPCR assays), detecting an amplification product includes detecting a signal emitted by a fluorescent label attached to the 5' end of a cleavable probe that selectively hybridizes to the amplification product during amplification. The cleavable probe further includes a quencher that quenches the fluorescent label to a 'baseline' fluorescence level. The 5' end of the cleavable probe is cleaved by the polymerase during the extension step, resulting in the separation of the fluorescent label from the quencher and a corresponding increase in fluorescence over baseline. As the PCR reaction progresses, the continuing increase in fluorescence over baseline is measured at each cycle. In some embodiments, an amplification product from the N gene of SARS-CoV-2 is detected in a first channel based on a first signal emitted by the VIC dye attached to a probe that selectively hybridizes to the corresponding amplification product from the N gene. Optionally, a second amplification product from the S gene of SARS-CoV-2 is detected in a second channel based on a second signal emitted by the ABY dye attached to a probe that selectively hybridizes to the corresponding amplification product from the S gene. Optionally, a third amplification product from the ORF1ab gene of SARS-CoV-2 is detected in a third channel based on a third signal emitted by the FAM dye attached to a probe that selectively hybridizes to the corresponding amplification product from the ORF1ab gene. Optionally, a fourth amplification product from a control or reference sequence is detected in a fourth channel based on a fourth signal emitted by the JUN dye attached to a probe that selectively hybridizes to the corresponding amplification product from the control or reference sequence.

In some embodiments, a passive reference dye, such as ROX™ is included in the reaction mixture. The metric "Rn" is optionally used to track progress of the amplification reaction and to determine the amount of target sequence originally present in the reaction mixture prior to amplification. Rn can be calculated as the fluorescence of the reporter dye divided by the fluorescence of a passive reference dye present in the reaction mixture; i.e., Rn is the reporter signal normalized to the fluorescence signal of the passive reference dye. In some embodiments, Rn is plotted against PCR cycle number. In some embodiments, ΔRn (calculated as Rn minus the baseline) can be plotted against PCR cycle number. In some embodiments, an amplification plot shows the variation of log (ΔRn) with PCR cycle number. $C_t$ (threshold cycle) is the intersection between an amplification curve and a threshold line. The lower the Ct value for a given amplification product, the earlier the amplification is detectable and the higher the absolute amount, and the relative concentration, of the corresponding target sequence originally present in the reaction mixture. In some embodiments, cutoffs for Ct are used to determine whether a target sequence was originally present or absent in the reaction mixture prior to amplification. For example, in some embodiments a target sequence is determined to be present if the Ct value is less than or equal to 37.

In some embodiments, emerging variants of SARS-CoV-2 are detectable even if such variants include mutations in one or more of the target regions described above (i.e., ORF1ab protein, S protein, or N protein regions). By looking at multiple target regions within the SARS-CoV-2 genome, accurate detection is achievable even in situations where mutations are significant enough to lead to a negative test result in one (or even two) of the target regions. For example, newly emerging variant B.1.1.7 (often referred to as "the UK variant") has an unusual number of mutations associated with the S protein region. These mutations are substantial enough that some test components and protocols designed for earlier SARS-CoV-2 variants will show a negative result for the S protein region. However, the built-in redundancy of looking at multiple regions ensures that the overall test is still capable of detecting the SARS-CoV-2 variant B.1.1.7 (based on positive ORF1ab and/or N protein region detection) without significant effects on the overall accuracy of the test. In another example, the 501Y.V2 variant (discovered in South Africa) has not been found to affect detection of the S protein region or any of the other tested regions described herein. Nevertheless, the robustness and redundancy of embodiments that target multiple regions of the SARS-CoV-2 genome limit the risk that these variants, or others that emerge in the future, will significantly impact the overall accuracy of SARS-CoV-2 detection.

To maximize the specificity of a genetic assay for SARS-CoV-2, primers and probes were designed that targeted the coding regions for ORF1ab, S protein, and N protein. In particular, the viral detection kits, arrays, assays, etc. disclosed herein include primers and/or probes specific for the SARS-CoV-2 genetic sequence encoding the S protein; none of the SARS-CoV-2 viral detection kits currently available target the S gene. Targeting the S gene (in addition to the coding regions associated with the N protein and ORF1ab) provides several advantages in terms of specificity and reliability. For example, at least some of the disclosed assays targeting the coding region for the S protein have been shown to differentiate between SARS-CoV and SARS-CoV-2 at the receptor binding level. Inclusion of these primers and/or probes targeting the S gene sequences offers higher specificity in detection of SARS-CoV-2 strains against other similar coronaviruses, especially in geographical regions where subjects present with co-infections of SARS-CoV and SARS-CoV-2.

The specificity of the primers and probes provided in SEQ ID NO:4-SEQ ID NO:2533 was estimated in silico using the standard mapping algorithm zper3p. These primers and probes were found to exhibit higher specificity for SARS-CoV-2 in silico than the primers and probes of other commercially available SARS-CoV-2 qPCR-based assays. Accordingly, the disclosed compositions, kits, and methods for detecting viral sequences include at least one primer and/or probe having a sequence defined by SEQ ID NO:4-SEQ ID NO:2533, which enables the singleplex and multiplex assays described herein to demonstrate a high level of sensitivity, specificity, and accuracy. In some embodiments, a first forward primer is SEQ ID NO: 160. In some embodiments, a second forward primer is SEQ ID NO: 100. In some embodiments, a third forward primer is SEQ ID NO: 211. In some embodiments, a first reverse primer is SEQ ID NO: 468. In some embodiments, a second reverse primer is SEQ ID NO: 337. In some embodiments, a third reverse primer is SEQ ID NO: 501 and/or 510. In some embodiments, the probes are SEQ ID NOs: 1049, 864 and/or 833. In some embodiments of the disclosed compositions, kits, and methods, the first forward primer is SEQ ID NO: 160, the second forward primer is SEQ ID NO: 100, the third forward primer is SEQ ID NO: 211, the first reverse primer is SEQ ID NO:

468, the second reverse primer is SEQ ID NO: 337, the third reverse primer is SEQ ID NO: 501 and/or 510, and the complementary probes are SEQ ID NOs 1049, 864 and 833, respectively.

For example, the sensitivity for the assays described herein can be at least 30 GCE/rxn, 25 GCE/rxn, 20 GCE/rxn, 15 GCE/rxn, or 10 GCE/rxn, including all ranges and numbers in between, for simultaneous detection of multiple targets or pathogens including any of those described herein. In some embodiments, the multiplex assays described herein demonstrate a linear dynamic range (LDR) of detection from $10^7$ to 10 GCE/rxn when calculated from a serial dilution. As used herein, "linear dynamic range (LDR)" refers to the range of input template (between the highest and lowest input RNA or DNA) for which acceptable linearity (R2 is ≥0.980) and efficiency (preferably between 90-110%) are observed.

In some embodiments, the singleplex assays described herein can demonstrate a sensitivity level down to 1-10 copies/μL input per reaction. For example, the sensitivity for the assays described herein can be as low as 20 copies/μL, 15 copies/μL, 10 copies/μL, 5 copies/μL, 4 copies/μL, 3 copies/μL, 2 copies/μL or 1 copy/μL per reaction, including all numbers and ranges in between. In some embodiments, the singleplex assays described herein can demonstrate an LDR over a range of at least 5 to 6 orders of magnitude with an R2>0.99 and a PCR efficiency near 100% using serial dilutions. For example, the singleplex assays described herein can demonstrate an LDR increase of at least $10^3$, $10^4$, $10^5$, or $10^6$. In some embodiments, a sample input range from $10^7$ down to $10^1$ copies, by serial dilution, is linear using the assays described herein.

In some embodiments, amplification of RNA viral genomes is achieved by performing reverse transcription followed by amplification of at least a portion of the resultant cDNA. Suitable methods are known in the art and include, for example, RT-PCR or RT-LAMP methods where the target sequence (e.g., viral RNA genome) is reverse transcribed to form a first cDNA strand, which is then copied in a template-dependent fashion to form a double stranded DNA sequence. The target sequence is then amplified from this double-stranded cDNA.

In some embodiments, RT-PCR is performed using samples comprising virus particles or suspected of comprising virus particles, which may be infectious virions, non-infectious or inactivated viral capsids enclosing the viral nucleic acid, or viral genomic RNA obtained from an infected cell. In such embodiments, the compositions, reaction mixtures, and kits disclosed herein can include at least one RNA-dependent DNA polymerase, generally termed a reverse transcriptase (RT), and related components for carrying out reverse transcription. RT-PCR may be performed using the compositions, reaction mixtures, and kits described herein, when, for example, RNA is the starting material for subsequent analysis.

In some embodiments, the RT-PCR may be a one-step procedure using one or more primers and one or more probes as described herein. In some embodiments, the RT-PCR may be carried out in a single reaction tube, reaction vessel (e.g., "single-tube" or "1-tube" or "single-vessel" reaction). In some embodiments, the RT-PCR may be carried out in a multi-site reaction vessel, such as a multi-well plate or array. In some embodiments, RT and PCR are performed in the same reaction vessel or reaction site, such as in 1-step or 1-tube RT-qPCR. Suitable exemplary RTs can include, for instance, a Moloney Murine Leukemia Virus (M-MLV) Reverse transcriptase, SuperScript Reverse Transcriptases (Thermo Fisher Scientific), SuperScript IV Reverse Transcriptases (Thermo Fisher Scientific), or Maxima Reverse Transcriptases (Thermo Fisher Scientific), or modified forms of any such RTs.

In some embodiments, only a single RT-qPCR assay (consisting of a given forward primer and a given reverse primer sequence) is included within a reaction vessel or volume, a reaction mode referred to as "singleplex" herein. Optionally, the singleplex qPCR assay can also include a single probe sequence in addition to the forward primer sequence and the reverse primer sequence. The probe sequence can be a hydrolysis probe sequence. Optionally, the probe includes an MGB (minor groove binding protein), as in TaqMan probes.

In some embodiments, the disclosed compositions and methods can be used in multiplex format, wherein two or more qPCR assays, each capable of amplifying and detecting a different target sequence, are present in a single reaction volume. In some embodiments, different assays in the same reaction volume will cause a corresponding different amplification product to be generated when the reaction volume is subjected to appropriate amplification conditions and multiple amplicons may be formed in the same reaction volume. The different amplification products can be produced simultaneously when the reaction volume is subjected to amplification conditions; alternatively, different amplification products may be produced serially or consecutively. For example, some assay reaction products may take longer to appear than others due to initial starting concentration of template or may benefit from different reaction conditions for optimal production.

In some embodiments, different assay products can be independently detected or at least discriminated from each other. For example, different assay products may be distinguished optically (e.g., using optically different labels for each qPCR assay whose emission spectra can be, for example, on the light spectrum, inclusive of infrared, UV, and visible light) or can be discriminated using some other suitable method, including as described in U.S. Patent Publication No. 2019/0002963, which is incorporated herein by reference in its entirety. In some embodiments, specific combinations of labels are used to differentiate between different pathogens, strains, and/or types of pathogens. For example, different respiratory pathogens or viruses may be differentiated from one another using different labels specific to each pathogen or virus such that the label is detectable only in the presence—and amplification—of the pathogen- or viral-specific nucleic acid sequence.

In some array-based embodiments, two or more different qPCR assays (each containing a forward primer, a reverse primer and optionally a probe) are present in a single well, cavity, site or feature of the array and products of each assay can be independently detected. For example, different assay products may be discriminated optically (e.g., using different labels present as components of each assay) or using some other suitable method, including as described in U.S. Patent Publication No. 2019/0002963. In some embodiments, at least one primer of each assay contains an optically detectable label that can be discriminated from the optical label of at least one other assay. For the purposes of this disclosure, a PCR assay, which for the sake of clarity is inclusive of any polymerase-driven amplification reaction disclosed herein (e.g., qPCR and RT-qPCR), is considered different from another PCR assay if the respective amplicons differ in nucleic acid sequence by at least one nucleotide.

In a preferred multiplex format, at least two different assays are combined into a single reaction volume to determine at least the presence of SARS-CoV-2 from a nucleic acid sample obtained or derived from a clinical or laboratory source.

It should be appreciated that the subject and type of sample may vary. For example, a nasopharyngeal swab has traditionally served as the gold standard in many clinical diagnostic situations, particularly those associated with upper respiratory tract infections. A nucleic acid fraction of the sample obtained by the nasopharyngeal swab can be extracted and used for downstream analysis, such as RT-qPCR. The swab (or other samples disclosed herein) may be obtained or collected from a human subject, but it should be appreciated that the disclosed embodiments can additionally extend to the processing of samples from non-human subjects, such as non-human animals. In some embodiments, the non-human animal subject can be a mink or other domesticated (or non-domesticated) animal, and the disclosed compositions, kits, and methods can be used to detect the presence of SARS-CoV-2 within the non-human animal (e.g., for diagnostic or screening purposes).

As an additional example, the collected sample may be a raw saliva sample. As provided herein, the raw saliva sample can be self-collected (e.g., within a saliva collection device or sterile tube) or collected from the subject by any other individual in proximity to the subject. In some embodiments, the raw saliva sample is collected directly into a sealable container without any preservation solution or other fluid or substance in the container prior to receipt of the saliva sample or as a result of closing/sealing the container. The disclosed embodiments for detecting viral nucleic acid from a sample can be adapted to detect viral nucleic acid directly from the saliva sample, or in alternative embodiments, the sample can undergo a specific RNA purification and/or extraction step prior to its use in a detection assay (e.g., RT-qPCR). Thus, it should be appreciated that in some embodiments, a subject sample (e.g., saliva) can directly serve as sample input for subsequent downstream analyses, such as PCR, and this can be accomplished, in some embodiments, with no nucleic acid purification and/or extraction step prior to its use.

In some embodiments, a method for detecting viral nucleic acid, particularly SARS-CoV-2, directly from a raw saliva sample can include collecting or receiving a saliva sample from a subject and heat treating the sample such as by placing the raw saliva sample on a heat block/water bath set to a temperature of 95° C. for 30 minutes. The heating step can provide many benefits, including, for example, denaturing nucleases such as RNase within the saliva that may interfere with accurate assessments of viral presence. Heating the raw saliva sample can also break down the mucus, making the sample more amenable to manipulation with laboratory equipment such as pipettes. The high heat can also cause thermal disruption of any prokaryotic and eukaryotic cells present in the sample and can also disrupt enveloped viruses and/or viral capsids present in the sample and thereby increase accessibility to any viral nucleic acid.

The method can additionally include mixing the heat-treated sample (e.g., via vortexing the sample for at least 10 seconds) before and/or after equilibrating the heat-treated sample to room temperature. A lysis solution can then be prepared and combined (e.g., in 1:1 proportions) with the heat-treated sample to create a probative template solution for detecting the presence of viral nucleic acid within the sample via nucleic acid amplification reactions (e.g., PCR, RT-PCR, qPCR, RT-qPCR, or the like). The lysis solution can include a nucleic-acid-amenable buffer such as TBE combined with a detergent and/or emulsifier (e.g., Tween-20, Triton-X-100, NP-40, or the like), the polysorbate-type nonionic surfactant. The detergent and/or emulsifier can promote better mixing of the reagents and may also act to increase accessibility to any viral nucleic acid within the sample (e.g., by removing lipid envelopes from virions).

Once the probative template solution is formed, it can be combined with PCR reagents and subjected to conditions suitable to generate viral-specific (e.g., SARS-CoV-2-specific, Flu AB-specific, and/or RSV-AB-specific) amplicons if the viral nucleic acid is present. In some embodiments, the primers can be selected from SEQ ID NO:4-SEQ ID NO:510 and can be coupled with one or probes generated from sequences disclosed in SEQ ID NO:520-SEQ ID NO:2533 to specifically identify the amplified coding regions associated with the SARS-CoV-2 N protein and S protein and/or ORF1ab region in addition to any other selected viral sequence to be identified. In some embodiments, the primers and/or probes can be included within a kit, which may additionally include an internal control primer and probe set for identifying a positive control coding sequence (e.g., endogenously present human RNase P RPP30 sequence). The foregoing and similar methods are beneficially compatible with some currently available assays/kits, such as the TaqCheck SARS-CoV-2 Fast PCR Assay, TaqCheck SARS-CoV-2 Control, and TaqCheck SARS-CoV-2 Control Dilution Buffer, and may additionally be compatible with preexisting thermal cycling master mixes, such as TaqPath 1-Step RT-qPCR Master Mix, CG.

Notably, in some embodiments, the nucleic acid amplification protocol can be configured for rapid processing (e.g., in less than about 45 minutes) and high throughput, allowing for a minimally invasive method to quickly screen large numbers of individuals in a scalable way. This can be particularly useful to perform asymptomatic testing (e.g., high frequency/widespread testing at schools, workplaces, conventions, sporting events, large social gatherings, etc.) or for epidemiological purposes. The disclosed embodiments can also beneficially provide a lower cost sample collection system and method that enables self-collection (reducing health care professional (HCP) staffing needs) using a low-cost collection device. This eliminates the requirements for swabs, buffers, virus transmission media (or other specialized transport medium), and the like. The disclosed embodiments also allow for a reduction in Personal Protective Equipment (PPE) requirements and costs. Because the reagents and methods are streamlined (e.g., no precursor nucleic acid purification and/or extraction step), there is a reduced use of nucleic acid preparation plastics which brings a coincident reduction in reagent costs and inventory costs. There is also a beneficial reduced dependence on supply-constrained items, and the compatibility of these methods and kit components with existing equipment improves the flexibility and simplicity of their implementation to the masses. Overall, such embodiments allow for a less expensive assay that can be accomplished more quickly from sample collection through result generation.

The disclosed methods for the direct detection of viral nucleic acids, particularly SARS-CoV-2, from a raw saliva sample are beneficially robust. For example, the probative template obtained from the raw saliva sample can be used and/or is compatible with many varied PCR reagents and/or commercially available kits. That is, in some embodiments, a saliva sample that is received directly from the subject (whether through self-collection or assisted collection), heat treated, and combined with a buffer/detergent mixture (e.g., a TBS/Tween-20 solution) for use as the sample input for existing PCR/LAMP kits and is otherwise compatible with many commercially available PCR/LAMP buffers, polymerases, and other PCR/LAMP reagents. Indeed, in some embodiments, no additional steps or modifications to the existing PCR/LAMP protocols are needed when using the heat-treated saliva sample in TBS/Tween-20 (or other buffer/detergent mixture) as the nucleic acid source for amplification. This allows for rapid adoption and implementation while maintaining the desired (and often requisite) specificity and reliability of a diagnostic test. In some embodiments, the disclosed methods for the direct detection of SARS-CoV-2 from a raw saliva sample has a sensitivity of <10,000 GCE/mL. In some embodiments, the methods and kits have a sensitivity of <5,000 GCE/mL, <2,500 GCE/mL, <1,000 GCE/mL, or any value or range therebetween. For example, An exemplary method for detecting viral nucleic acid, particularly SARS-CoV-2, directly from a raw saliva sample is provided in the Examples section below.

As provided herein, it should be appreciated that the nucleic acid sample can obtained from other body tissues or sources, including but not limited to bodily fluids other than saliva (e.g., blood, urine, sputum, and the like). In some embodiments, SARS-CoV-2 or other viruses are detected by analysis of swabs, or fluid obtained from swabs, such as throat swabs, nasal swabs, nasopharyngeal swabs, cheek swabs, saliva swabs, or other swabs. In some embodiments, the nucleic acid sample includes a total nucleic acid content isolated from a subject via nasopharyngeal swab, nasopharyngeal aspirate, and/or bronchoalveolar lavage. However, it should be appreciated that SARS-CoV-2 or other coronaviruses and/or other viruses may also be detected by analysis of urine samples, saliva samples, or other suitable clinical samples.

In some embodiments, particularly where the sample is not used directly to identify the presence of viral sequences, an initial step for detecting viral sequences can include subjecting each sample to a nucleic acid purification assay. The purified or otherwise extracted nucleic acid fraction of the subject sample is then added to the downstream detection assays. The total nucleic acid content can be isolated by any means known in the art, including, for example, using a MagMAX Viral/Pathogen Ultra Nucleic Acid Isolation Kit (sold by Thermo Fisher Scientific under Cat. No. A42356). In short, the MagMAX kit provides nucleic-acid-binding beads and other reagents for binding, washing, and eluting nucleic acid from a clinical/laboratory sample. These eluted nucleic acids preferably include the total nucleic acid content purified from the sample.

In some embodiments, the total nucleic acid content includes any genomic DNA and transcribed RNA derived from subject cells captured within the sample in addition to any genomic/transcribed nucleic acids derived from the subject's eukaryotic and/or prokaryotic microbiota captured during the sampling process. Any single-stranded (plus or minus) RNA, double-stranded RNA, cDNA derivatives thereof, single-stranded (plus or minus) DNA, or double-stranded DNA derived from viruses captured in the sample are also, preferably, included within the total nucleic acid content eluted from the clinical/laboratory sample. This eluted total nucleic acid content can then be used as the source of template nucleic acid within the disclosed RT-qPCR assays.

The compositions, reaction mixtures, and kits may also comprise any other components necessary for carrying out such RT-qPCR reactions, such as may be found in SuperScript IV VILO Master Mix (Thermo Fisher Scientific), TaqPath 1-Step RT-qPCR Master Mix (Thermo Fisher Scientific), TaqMan Fast Virus 1-Step Master Mix (Thermo Fisher Scientific) or any other suitable RT-PCR master mixes which may be commercially available. RT-PCR protocols are known within the art. Notwithstanding this, an exemplary RT-PCR protocol for use in the multiplex viral detection protocols described herein is set forth in the Examples.

In some embodiments, the reverse transcription and/or nucleic acid amplification assays as described herein are performed using a real-time quantitative PCR (qPCR) instrument, including for example a QuantStudio Real-Time PCR system, such as the QuantStudio 5 RealTime PCR System (QS5) and QuantStudio 12K Flex System (QS12K), or a 7500 Real-Time PCR system, such as the 7500 Fast Dx system, from Thermo Fisher Scientific.

The disclosed kits for detecting viral sequences contain, in some embodiments, one or more of the forward primers, reverse primers, and/or probes for detecting target nucleic acid sequences in the SARS-CoV-2 genome, such as disclosed in SEQ ID NO:4-SEQ ID NO:251; SEQ ID NO:267-SEQ ID NO:504 and SEQ ID NO:510; and SEQ ID NO:520-SEQ ID NO:1295 and SEQ ID NO:1466-SEQ ID NO:2359, respectively. In some embodiments, the primers described herein are included in the kits, array cards, and similar at a concentration from about 100 nM to 1 mM (e.g. 300 nM, 400 nM, 500 nM, etc.), including all concentration amounts and ranges in between. In some embodiments, the probes described herein are used in a nucleic acid assay at a concentration from about 50 nM to 500 nM (e.g., 75 nM, 125 nM, 250 nM, etc.), including all concentration amounts and ranges in between.

The disclosed kits, arrays, etc. disclosed herein can include reagents for performing a nucleic acid amplification method, as discussed herein, disclosed herein typically include at least one primer pair (e.g., a forward primer selected from SEQ ID NO:4-SEQ ID NO:251 and a reverse primer selected from SEQ ID NO:267-SEQ ID NO:504 and SEQ ID NO:510) directed to a SARS-CoV-2 target nucleic acid sequence, a nucleic acid polymerase (e.g., temperature-tolerant DNA-dependent DNA polymerases such as Taq or RNA-dependent DNA polymerases, also known as reverse transcriptase), and a pool of deoxynucleotide triphosphates (dNTPs) for synthesizing cDNA templates and/or amplicons. Each of the foregoing can be included individually within the disclosed kits, as needed, in concentrations suitable for the various thermal cycling reactions in which they are used, as known in the art. In some embodiments, the kits can additionally include buffers and/or salts at an appropriate concentration for the generation of a reaction mixture that, for example, increases levels of polymerase activity in the reaction mixture, as known in the art or otherwise disclosed herein.

In some embodiments, optimal amplification and detectability for viral genomes is achieved by the disclosed kits using a master mix included therein and which can be added to the reaction volume prior to amplification. A master mix can include, for example, one or more of a nucleic acid polymerase, dNTPs, buffers, and salts—all of which are included in the master mix at the appropriate concentration such that when the desired volume of sample is added (with or without balancing volumes of PCR-grade water). In some embodiments (particularly multiplex assays), the disclosed kits and/or reaction volumes can include TaqMan Fast Virus 1-Step Master Mix (sold by Thermo Fisher Scientific under Catalog No. 44444432), or alternatively, TaqPath 1-Step RT-qPCR Master Mix, CG (sold by Thermo Fisher Scientific under Catalog No. A15299). In other embodiments the master mix is TaqPath 1 Step Multiplex Master Mix (No ROX) (sold by Thermo Fisher Scientific under Catalog Nos. A48111 and A28521) or similar master mix known in the art. In some embodiments, the kit includes primers, probes, and master mix sufficient to constitute a reaction mixture supporting multiplex amplification of one or more SARS-CoV-2 regions encoding the N protein, the S protein and/or ORF1ab protein in a single reaction volume.

In some embodiments, the kit includes at least one qPCR assay (including forward primer, reverse primer, probe, and optionally a master mix or components thereof) configured to amplify a region of the gene encoding the ORF1ab protein. In some embodiments, the kit includes at least one qPCR assay (including forward primer, reverse primer, probe, and optionally a master mix or components thereof) configured to amplify a region of the gene encoding the N protein. In some embodiments, the kit includes at least one qPCR assay (including forward primer, reverse primer, probe, and optionally a master mix or components thereof) configured to amplify a region of the gene encoding the S protein. In some embodiments, the kit includes at least one qPCR assay (including forward primer, reverse primer and optionally a probe) configured to amplify a region of the gene encoding the N protein, at least one qPCR assay (including forward primer, reverse primer, probe, and optionally a master mix or components thereof) configured to amplify a region of the gene encoding the S protein, and/or at least one qPCR assay (including forward primer, reverse primer, probe, and optionally a master mix or components thereof) configured to amplify a region of the gene encoding the ORF1ab protein.

In some embodiments, the primers and/or probes associated with SEQ ID NO:4-SEQ ID NO:2533 and/or Table 2 may further comprise a fluorescent or other detectable label and/or a quencher or minor groove binder, such as those described above. As a non-limiting example, said primers and/or probes can be associated with FAM, ABY, VIC, or JUN as detectable labels and QSY as a quencher. As such, it should be appreciated that the primers and probes of SEQ ID NO:4-SEQ ID NO:2533 and/or Table 2 may be included with disclosed kits, arrays, etc. for use in either singleplex or multiplex assay formats.

In some embodiments of multiplex assay formats described herein, one or more various SARS-CoV-2 genomic regions are detected, including assays for detecting the coding regions of ORF1ab (e.g., FAM-labeled), N Protein (e.g., VIC-labeled), and/or S Protein (e.g., ABY-labeled). As described above, one or more labelled primers may be used, in addition to or as an alternative to labelled probes, for detecting one or more target nucleic acids. Thus, in some embodiments, no probes are utilized.

In some embodiments of multiplex assay formats described herein, various SARS-CoV-2 genomic regions are detected, including assays for the coding regions of N Protein and S Protein (e.g., both FAM-labeled), optionally combined with assays for Flu A (e.g., VIC-labeled) and/or Flu B (e.g., ABY-labeled). In some embodiments of multiplex assay formats described herein, various SARS-CoV-2 genomic regions are detected, including assays for detecting the coding regions of N Protein and S Protein (e.g., VIC-labeled), optionally combined with assays for Flu A and/or B (e.g., both FAM-labeled) and/or for RSV Type A and/or Type B (e.g., both ABY-labeled). Optionally, in some embodiments, a control (e.g., JUN-labeled), such as bacteriophage MS2 or RNase P control, is included in the kit, array, etc. comprising the multiplex assay. It should be appreciated that although particular examples are provided above indicating a given fluorophore associated with detection of a given viral sequence, the primers and/or probes can be modified to include a functionally similar fluorophore described herein or as otherwise known in the art. Further, quenchers, such as QSY, can be included in any of the foregoing examples, and the detectable label and/or quencher can be selected based on the singleplex or multiplex requirements of the given qPCR assay in accordance with the constraints and considerations discussed above or otherwise understood by those having skill in the art.

In some embodiments, at least one of the qPCR assays targets a sequence within a SARS-CoV-2 gene selected from the group consisting of: the N protein, the ORF1ab protein, and the S protein. In some embodiments, the reaction volume further includes a second qPCR assay targeting a different gene of the aforementioned group. In some embodiments, the reaction volume further includes a third qPCR assay that targets the remaining third gene from the aforementioned group, such that when the reaction volume is subjected to amplification conditions, and if the sample includes SARS-CoV-2 genomic RNA, at least one amplicon is produced from genetic sequence encoding the S protein, at least one amplicon from genetic sequence encoding the N protein and at least one amplicon from the genetic sequence encoding the ORF1ab protein.

In a further multiplex format, at least two qPCR assays are combined into a single reaction volume that includes a nucleic acid sample obtained or derived from body tissue, as described herein, and at least one exogenous positive control nucleic acid sequence. The exogenous positive control sequence may comprise an MS2 phage sequence/gene or other nucleic acid sequence, preferably RNA sequence. Additionally, or alternatively, the multiplex qPCR assays include an endogenous positive control, such as human RNase P. In some embodiments, the primer and/or probe sequences described by the United States Centers for Disease Control and Prevention (CDC) may be utilized (https://www.cdc.gov/coronavirus/2019-ncov/lab/rt-pcr-panel-primer probes.html). For example, assays described herein may include one or more primers and/or probes shown in Table 2.

TABLE 2

CDC 2019-Novel Coronavirus (2019-nCoV) Real-time RT-PCR Primers and Probes

| Name/Description | SEQ ID NO | Labels[1,2] | Oligonucleotide Sequence (5' > 3') | Final Conc.* |
|---|---|---|---|---|
| 2019-nCoV_N1 Forward Primer | SEQ ID NO: 2544 | None | GAC CCC AAA ATC AGC GAA AT | 500 nM |
| 2019-nCoV_N1 Reverse Primer | SEQ ID NO: 2545 | None | TCT GGT TAC TGC CAG TTG AAT CTG | 500 nM |

TABLE 2-continued

CDC 2019-Novel Coronavirus (2019-nCoV) Real-time RT-PCR Primers and Probes

| Name/Description | SEQ ID NO | Labels[1,2] | Oligonucleotide Sequence (5' > 3') | Final Conc.* |
|---|---|---|---|---|
| 2019-nCoV_N1 Probe | SEQ ID NO: 2546 | FAM, BHQ-1 | FAM-ACC CCG CAT TAC GTT TGG TGG ACC-BHQ1 | 125 nM |
| 2019-nCoV_N1 Probe | SEQ ID NO: 2547 | FAM, ZEN, 3IABkFQ | FAM-ACC CCG CAT /ZEN/ TAC GTT TGG TGG ACC-3IABkFQ | 125 nM |
| 2019-nCoV_N2 Forward Primer | SEQ ID NO: 2548 | None | TTA CAA ACA TTG GCC GCA AA | 500 nM |
| 2019-nCoV_N2 Reverse Primer | SEQ ID NO: 2549 | None | GCG CGA CAT TCC GAA GAA | 500 nM |
| 2019-nCoV_N2 Probe | SEQ ID NO: 2550 | FAM, BHQ-1 | FAM-ACA ATT TGC CCC CAG CGC TTC AG-BHQ1 | 125 nM |
| 2019-nCoV_N2 Probe | SEQ ID NO: 2551 | FAM, ZEN, 3IABkFQ | FAM-ACA ATT TGC /ZEN/ CCC CAG CGC TTC AG-3IABkF | 125 nM |
| RNase P Forward Primer | SEQ ID NO: 2552 | None | AGA TTT GGA CCT GCG AGC G | 500 nM |
| RNase P Reverse Primer | SEQ ID NO: 2553 | None | GAG CGG CTG TCT CCA CAA GT | 500 nM |
| RNase P Probe | SEQ ID NO: 2554 | FAM, BHQ-1 | FAM - TTC TGA CCT GAA GGC TCT GCG CG - BHQ-1 | 125 nM |
| RNase P Probe | SEQ ID NO: 2555 | FAM, ZEN, 3IABkFQ | FAM-TTC TGA CCT /ZEN/ GAA GGC TCT GCG CG-3IABkFQ | 125 nM |
| RNase P Probe | SEQ ID NO: 2556 | VIC, QSY | VIC-TTC TGA CCT GAA GGC TCT GCG CG-QSY | 125 nM |

[1]The labels shown are exemplary to some embodiments of the compositions, reactions mixtures, kits or methods described herein and are in no way meant to limit other possible labels, including various fluorophores and quenchers, contemplated for use in the primers and probes described herein.
[2]TaqMan ® probes are labeled at the 5'-end with the reporter molecule 6-carboxyfluorescein (FAM) and with the quencher, Black Hole Quencher 1 (BHQ-1) (Biosearch Technologies, Inc., Novato, CA) at the 3'-end. TaqMan ® probes can also be labeled at the 5'-end with the reporter molecule 6-carboxyfluorescein (FAM) and with a double quencher, ZEN™ Internal Quencher positioned between the ninth (9th) and tenth (10th) nucleotide base in the oligonucleotide sequence and Iowa Black ® FQ (3IABkFQ) located at the 3'-end (Integrated DNA Technologies, Coralville, IA).
*The final concentrations shown are exemplary to some embodiments of the compositions, reactions mixtures, kits, or methods described herein and are in no way meant to limit other possible concentrations or concentration ranges for use in the compositions, reactions mixtures, kits, or methods contemplated herein.

In some embodiments, kits are provided that include reagents for a multiplex qPCR assay targeting a SARS-CoV-2 sequence selected from the coding regions of the ORF1ab protein, the N protein, and/or the S protein. In some embodiments, the kits additionally include reagents for a second qPCR assay targeting a different, SARS-CoV-2 sequence selected from the coding regions of the ORF1ab protein, the N protein, and the S protein. In some embodiments, the kits additionally include reagents for a third qPCR assay targeting the third SARS-CoV-2 sequence selected form the coding regions associated with the ORF1ab protein, the N protein, and the S protein, such that when a reaction volume containing reagents from the first, second, and third qPCR assays is subjected to amplification conditions—and if the nucleic acid sample being tested includes SARS-CoV-2 genomic RNA (or cDNA reverse transcribed therefrom)—at least one amplicon is produced from the coding region associated with the ORF1ab protein, at least one amplicon is produced from the coding region associated with the S protein, and at least one amplicon is produced from the coding region associated with the N protein (e.g., using a first forward primer selected from SEQ ID NO:4, SEQ ID NO:34, and SEQ ID NO:160, a second forward primer selected from SEQ ID NO:5 and SEQ ID NO:100, and a third forward primer selected from SEQ ID NO:211 and SEQ ID NO:248; using a first reverse primer selected from SEQ ID NO:320, SEQ ID NO:423, and SEQ ID NO:468, a second reverse primer selected from SEQ ID NO:337 and SEQ ID NO:441, and a third reverse primer selected from SEQ ID NO:487 SEQ ID NO:501, and 510; and using complementary probes selected from SEQ ID NO:520-SEQ ID NO:1295 and/or SEQ ID NO:1466-SEQ ID NO:2359; preferably one or more probes selected from SEQ ID NO: 821-1054, SEQ ID NO: 1853-2027, SEQ ID NO: 2028-2220, and/or SEQ ID NO: 2221-2359; and more preferably one or more probes selected from SEQ ID NO:565, SEQ ID NO:599, SEQ ID NO:833, SEQ ID NO:864, SEQ ID NO:930, SEQ ID NO:971, SEQ ID NO:1049, SEQ ID NO:1106, SEQ ID NO:1160, SEQ ID NO:1203, SEQ ID NO:1866, SEQ ID NO:1891, SEQ ID NO:1962, SEQ ID NO:2031, SEQ ID NO:2188, SEQ ID NO:2203, SEQ ID NO:2216, SEQ ID NO:2248, SEQ ID NO:2291, and/or SEQ ID NO:2345). In some embodiments, the first forward primer is SEQ ID NO: 160. In some embodiments, the second forward primer is SEQ ID NO: 100. In some embodiments, the third forward primer is SEQ ID NO: 211. In some embodiments, the first reverse primer is SEQ ID NO: 468. In some embodiments, the second reverse primer is SEQ ID NO: 337. In some embodiments, the third reverse primer is SEQ ID NO: 501 and/or 510. In some embodiments, the complementary probes are SEQ ID NOs: 1049, 864 and/or 833. In some embodiments the first forward primer is SEQ ID NO: 160, the second forward primer is SEQ ID NO: 100, the third forward primer is SEQ ID NO: 211, the first reverse primer is SEQ ID NO: 468, the second reverse primer is SEQ ID NO: 337, the third reverse primer is SEQ ID NO: 501 and/or 510, and the complementary probes are SEQ ID NOs 1049, 864 and 833, respectively.

The primer and probe sequences described herein need not have 100% homology to their targets to be effective, though in some embodiments, homology is substantially 100%. In some embodiments, one or more of the disclosed primer and/or probe sequences have a homology to their respective target of about 50%, about 60%, about 70%, about 80%, about 85%, about 90%, about 95%, about 97%, about 98%, about 99%, or up to substantially 100%. Some combinations of primers and/or probes may include primers and/or probes each with different homologies to their respective targets, and the homologies may be, for example, within a range with endpoints defined by any two of the foregoing values.

In some embodiments, the multiplex qPCR kits disclosed herein additionally include reagents for a fourth qPCR assay targeting an exogenous/endogenous positive control sequence, such that when the multiplex reaction volume is subjected to amplification conditions—and if the sample includes SARS-CoV-2 genomic RNA and subject-derived nucleic acid or exogenously added template nucleic acid—at least one amplicon is produced from the coding region associated with the ORF1ab protein, at least one amplicon is produced from the coding region associated with the S protein, at least one amplicon is produced from the coding region associated with the N protein, as above, and at least one amplicon is produced from the exogenous/endogenous positive control sequence. If the positive control sequence is an endogenously-derived control, such as RNase P, the presence of subject-derived nucleic acid (e.g., genomic DNA coding for RNase P, RNase P RNA, and/or reverse transcribed RNase P transcript), can be used as the template for an RNase P qPCR assay. Exemplary primers and probes for such an RNase P qPCR positive control can include SEQ ID NO:2552-SEQ ID NO:2556, although those having skill in the art should appreciate that other RNase-P-specific primers and/or probes could be used. If the positive control sequence is an exogenously-derived control, such as a component of the MS2 bacteriophage, a known or predetermined concentration of template nucleic acid is added to the reaction volume to serve as the requisite template for an MS2 qPCR assay. Exemplary primers and probes for an exogenous MS2 qPCR positive control can include SEQ ID NO:256, SEQ ID NO:509, and SEQ ID NO:1300, although those having skill in the art should appreciate that other MS2-specific primers and/or probes could be used.

In some embodiments, the singleplex and multiplex assays can include synthetic DNA controls and/or genomic RNA controls for the pathogenic targets being tested, clinical isolate research samples, and/or organism samples. The compositions and kits can also include a control DNA construct comprising a plasmid carrying the target sequences of the N protein, the S protein and the ORF1ab protein. The control plasmid can additionally include an RNase P coding sequence for use as a positive control and/or a Xeno cassette for monitoring sample contamination. In some embodiments, the synthetic control construct is provided in a separate kit with the same primers and probes included within a complementary kit used to detect SARS-CoV-2 viral nucleic acid from a biological sample. These two kits can be manufactured, in some embodiments, at different locations to prevent any possible cross-contamination of the control plasmid within the detection kits (which would result in false positive sample results).

In some embodiments, the multiplex RT-qPCR kits disclosed herein additionally include reagents for a fifth qPCR assay that targets two separate (exogenous/endogenous) positive control sequences, such that when the reaction volume is subjected to amplification conditions—and if the sample includes SARS-CoV-2 genomic RNA and subject-derived nucleic acid or exogenously added template nucleic acid—at least one amplicon is produced from the coding region associated with the ORF1ab protein, at least one amplicon is produced from the coding region associated with the S protein, at least one amplicon is produced from the coding region associated with the N protein, as above, and at least two amplicons are produced from the exogenous and/or endogenous positive control sequence(s) (e.g., using primers and probes for RNase P and/or MS2 described above, or other selective and specific primers and probes that can serve as a positive control in the qPCR assays described herein).

In some embodiments, the disclosed primers and probes (including those listed in SEQ ID NO:4-SEQ ID NO:2533) are used in a multiplex assay format that targets at least two different loci in the SARS-CoV-2 genome, namely: the gene encoding ORF1ab, the gene encoding the S protein, and/or the gene encoding the N protein. In some embodiments, the disclosed primers and probes are used in a multiplex assay format that targets at least three loci in the SARS-CoV-2 genome, namely: the gene encoding ORF1ab, the gene encoding the S protein, and the gene encoding the N protein. A single qPCR reaction volume includes multiple assays for each of these target genes to ensure redundancy and specific identification of the target virus.

For example, a multiplex assay of the present disclosure includes a 4-plex assay where three of the four dye channels are each dedicated to the identification of a different SARS-CoV-2 coding region, particularly portions of the coding regions associated with the N protein, the S protein, or ORF1ab that allow for the specific and selective identification of SARS-CoV-2. The fourth dye channel can be used for the identification of a positive control (e.g., an exogenously added control like MS2 or an endogenously present control like RNase P). That is, multiplex assays of the present disclosure can include probes having sequence specificity for coding regions of the N protein, S protein, or ORF1ab coupled to a detectable label and/or quencher as proved herein. As a non-specific example, a multiplex assay can include a first probe targeting a SARS-CoV-2-specific N protein coding sequence and having a VIC dye associated therewith. A second probe of the multiplex assay can target a SARS-CoV-2-specific S protein coding sequence and have an ABY dye associated therewith. A third probe of the multiplex assay can target a SARS-CoV-2-specific ORF1ab coding sequence and have a FAM dye associated therewith. A fourth probe of the multiplex assay can be specific for a positive control sequence and have a JUN dye associated therewith. One having skill in the art will recognize that the foregoing dyes can be interchanged or exchanged for another detectable label known in the art.

In some embodiments, a 4-plex assay includes at least two SARS-CoV-2-specific probes sharing the same dye channel. Second and third dye channels of the 4-plex assay can be associated with Flu A- and Flu B-specific probes, respectively, and the fourth dye channel can be associated with RSV A and/or RSV B specific probes or a positive control probe. Alternatively, a second dye channel can be shared by Flu A and Flu B specific probes, a third channel can be associated with RSV A and/or RSV B specific probes, and a fourth dye channel can be associated with a positive control probe. Alternatively, the third dye channel can be associated with a Flu A-specific probe, and the fourth channel can be associated with a Flu B-specific probe.

In some embodiments, a 4-plex assay includes at least two SARS-CoV-2-specific probes sharing the same dye channel. Second and third dye channels of the 4-plex assay can be associated with RSV A-specific and RSV B-specific probes, respectively, and the fourth dye channel can be associated with Flu A- and/or Flu B-specific probes or a positive control probe. Alternatively, a second dye channel can be shared by RSV A and RSV B specific probes, a third channel can be associated with Flu A- and/or Flu B-specific probes, and a fourth dye channel can be associated with a positive control probe. Alternatively, the third dye channel can be associated with an RSV A-specific probe, and the fourth channel can be associated with an RSV B-specific probe.

The disclosed primers and probes can be included within additional and/or alternative multiplex assays. For example, a 5-plex assay can include at least two SARS-CoV-2-specific probes (e.g., for N protein, S protein, and/or ORF1ab amplicons). The probes can be associated with different dye channels or can share the same dye channel. In some embodiments, detection between CoV-2 N Protein and S Protein genomic sequences is not distinguished. In some embodiments, detection between CoV-2 N Protein genomic sequence and S Protein genomic sequence is distinguished. Additional, second, third, and/or fourth, dye channels can be associated with, for example, Flu A-specific and/or Flu B-specific probes and/or RSV A-specific and/or RSV B-specific probes. A positive control probe can additionally be included in some embodiments. As a particular, non-limiting example, regions within the genes encoding SARS-CoV-2 N protein, S protein, and/or ORF1ab may be detected using a single dye channel (e.g., VIC) while combined assays for Influenza Type A and/or B and/or for RSV Type A and/or B are simultaneously detected in the same reaction using one or more different dye channels (e.g., FAM, ABY and/or JUN). In one embodiment, at least two SARS-CoV-2-specific detectable primers and/or probes can be associated with a single dye channel, such as by labeling with a VIC dye, and optionally, a Flu A-specific detectable primer and/or probe can be associated with second dye channel, such as by labeling with an ABY dye and/or a Flu B-specific detectable primer and/or probe can be associated with a third dye channel, such as by labeling with a FAM dye. In another embodiment, assays for SARS-CoV-2 and/or Influenza Type A and/or Type B can be further combined with RSV A and RSV B detectable primers and/or probes to include detection through yet another dye channel, such as through respective association a JUN dye. Optionally, a fifth channel can be reserved for an MS2 or RNase P positive control primers and/or probes associated with an ALEXA (AF) dye.

Compositions, Kits, and Methods for Detection of Multiple Respiratory Tract Pathogens The compositions, kits, and methods for detecting SARS-CoV-2, described above and elsewhere herein, can form the basis of an assay for detecting multiple respiratory tract pathogens. For example, the qPCR assays described above (whether singleplex or multiplex) can be included as a component of a panel of qPCR assays or as a multiplex assay for detecting a plurality of pathogens from a subject sample.

In some embodiments, a panel of qPCR assays includes one or more assays for detecting SARS-CoV-2 in addition to one or more assays for detecting Flu A and/or Flu B viruses. In some embodiments, the panel of qPCR assays includes one or more assays for SARS-CoV-2 in addition to one or more assays for RSV A and/or RSV B. In some embodiments, the panel of qPCR assays includes one or more assays for SARS-CoV-2 in addition to one or more assays for Flu A and/or Flu B viruses, and one or more assays for RSV A and/or RSV B. In some embodiments, the panel of qPCR assays includes at least two assays for SARS-CoV-2 in addition to at least two assays for Flu A and/or Flu B viruses, and at least two assays for RSV A and/or RSV B.

It should be appreciated that the panel of qPCR assays can be performed in a singleplex format, allowing the probes for each qPCR target to be shared between the various assays. Alternatively, the qPCR assays can be performed in a multiplex format with each component of the panel being associated with a different probe whose emission spectra do not substantially overlap (i.e., the emission spectra of each probe is uniquely identifiable from the other probes).

In some embodiments, the panel of qPCR assays includes one or more assays for SARS-CoV-2 in addition to one or more assays for a control sequence. In some embodiments, the control sequence is an RNase P sequence and/or a MS2 Phage sequence. In some embodiments, the panel of qPCR assays includes one or more assays comprising any of the forward primers, reverse primers, and probe sequences listed in SEQ ID NO:4-SEQ ID NO:2533. It should be appreciated that qPCR and RT-qPCR methods are known to those having skill in the art. Nevertheless, particular embodiments are provided in the Examples illustrating use of qPCR assays for detecting SARS-CoV-2, Flu A and/or Flu B, and/or RSV A, and/or RSV B targets.

In some embodiments, the panel of qPCR assays includes four or more assays comprising any of the forward primers, reverse primers, and probe sequences listed in SEQ ID NO:4-SEQ ID NO:2533. In some embodiments, the panel of qPCR assays includes six or more assays comprising any of the forward primers, reverse primers and probes sequences listed in SEQ ID NO:4-SEQ ID NO:2533. Each qPCR assay can include a forward primer and a reverse primer. Optionally, the assay further includes a probe, which can be a hydrolysis probe. In some embodiments, each qPCR assay includes at least one forward primer, at least one reverse primer, and at least one probe selected from any of those listed in SEQ ID NO:4-SEQ ID NO:257, SEQ ID NO:267-SEQ ID NO:510, and SEQ ID NO:520-SEQ ID NO:2533, respectively.

In some embodiments, the panel of qPCR assays includes at least one qPCR assay for detecting SARS-CoV-2, plus at least one qPCR assay for detecting at least one assay for a respiratory microorganism listed in Table 3A, below. In some embodiments, the panel of qPCR assays includes at least one qPCR assay for detecting SARS-CoV-2, plus at least one qPCR assay for detecting each of the microorganisms listed in Table 3A. In some embodiments, the assay detects two or more (e.g., 2, 3, 4, 5, 6, etc.) of the targets of Table 3A. In some embodiments, the assay detects at least two targets within the SARS-CoV-2 genome as well an internal positive control (see, e.g., Table 3B), such as human RNase P. In some embodiments, the assay simultaneously detects every target of Table 3A in addition to one or more positive control, such as for RNase P and/or 18S rRNA and/or an exogenous control like bacteriophage MS2 (see, e.g., Table 3A). In some embodiments, the panel of assays is formatted as an open array card. In other embodiments, the panel of assays is formatted as an open array plate. In some embodiments, the panel of assays are used in a plurality of singleplex assays. In some other embodiments, the panel of assays are used in one or more multiplex assays. In some embodiments, the panel of assays includes pooled assays. In some embodiments, the panel of assays includes dried down and/or lyophilized assays.

TABLE 3A

List of targets and assays for respiratory tract microbiota (RTM)

| Target organism | Assay name | Nucleic acid | Assay ID (Thermo Fisher Scientific) |
|---|---|---|---|
| Bacteria | | | |
| Bordetella bronchiseptica/parapertussis/pertussis | Bordetella | DNA | Ba06439624_s1 |
| Bordetella pertussis | B. pertussis | DNA | Ba06439623_s1 |
| Chlamydophila pneumoniae | C. pneumoniae | DNA | Ba06439616_s1 |
| Haemophilus influenzae | H. influenzae | DNA | Ba06439625_s1 |
| Klebsiella pneumoniae | K. pneumoniae | DNA | Ba04932083_s1 |
| Legionella pneumophila | L. pneumophila | DNA | Ba06439617_s1 |
| Mycoplasma pneumoniae | M. pneumoniae | DNA | Ba06439620_s1 |
| Staphylococcus aureus | S. aureus | DNA | Ba04646259_s1 |
| Streptococcus pneumoniae | S. pneumoniae | DNA | Ba06439619_s1 |
| Bordetella holmesii | B. holmesii | DNA | Ba06439621_s1 |
| Coxiella burnetii | C. burnetii | DNA | Ba06439618_s1 |
| Moraxella catarrhalis | M. catarrhalis | DNA | Ba06439622_s1 |
| Virus | | | |
| Adenovirus | AdV_1of2 | DNA | Vi99990001_po |
| Adenovirus | AdV_2of2 | DNA | Vi99990002_po |
| Human Bocavirus | HBoV | DNA | Vi99990003_po |
| Human Coronavirus 229E | CoV_229E | RNA | Vi06439671_s1 |
| Human Coronavirus HKU1 | CoV_HKU1 | RNA | Vi06439674_s1 |
| Human Coronavirus NL63 | CoV_NL63 | RNA | Vi06439673_s1 |
| Human Coronavirus OC43 | CoV_OC43 | RNA | Vi06439646_s1 |
| Human Enterovirus (pan assay) | EV_pan | RNA | Vi06439631_s1 |
| Human Enterovirus D68 | EV_D68 | RNA | Vi06439669_s1 |
| Human Metapneumovirus (hMPV) | hMPV | RNA | Vi99990004_po |
| Human Parainfluenza virus 1 | hPIV1 | RNA | Vi06439642_s1 |
| Human Parainfluenza virus 2 | hPIV2 | RNA | Vi06439672_s1 |
| Human Parainfluenza virus 3 | hPIV3 | RNA | Vi06439670_s1 |
| Human Parainfluenza virus 4 | hPIV4 | RNA | Vi99990005_po |
| Human Respiratory Syncytial Virus A (RSVA) | RSVA | RNA | Vi99990014_po |
| Human Respiratory Syncytial Virus B (RSVB) | RSVB | RNA | Vi99990015_po |
| Human Rhinovirus 1/2 | RV_1of2 | RNA | Vi99990016_po |
| Human Rhinovirus 2/2 | RV_2of2 | RNA | Vi99990017_po |
| Human herpesvirus 3 (HHV3 - Varicella zoster Virus) | HHV3 | DNA | Vi06439647_s1 |
| Human herpesvirus 4 (HHV4 - Epstein-Barr Virus) | HHV4 | DNA | Vi06439675_s1 |
| Human herpesvirus 5 (HHV5 - Cytomegalovirus) | HHV5 | DNA | Vi06439643_s1 |
| Human herpesvirus 6 (HHV6) | HHV6 | DNA | Vi06439627_s1 |
| Influenza A | Flu_A_pan | RNA | Vi99990011_po |
| Influenza A/H1-2009 | Flu_A_H1 | RNA | Vi99990009_po |
| Influenza A/H3 | Flu_A_H3 | RNA | Vi99990010_po |
| Influenza B | Flu_B_pan | RNA | Vi99990012_po |
| Human Parechovirus | HPeV | RNA | Vi99990006_po |
| Measles virus | Measles | RNA | Vi99990013_po |
| Middle East Respiratory Syndrome coronavirus (MERS) | MERS_CoV | RNA | Vi06439644_s1 |
| Mumps virus | Mumps | RNA | Vi06439657_s1 |
| Severe Acute Respiratory Syndrome coronavirus (SARS) | SARS_CoV | RNA | Vi06439634_s1 |
| Fungus | | | |
| Pneumocystis jirovecii | P. jirovecii | DNA | Fn06439626_s1 |

TABLE 3B

Assays for respiratory tract microbiota controls

| Control name | Assay name | Nucleic acid | Assay ID (Thermo Fisher Scientific) |
|---|---|---|---|
| TaqMan ® Universal Extraction Control Organism (*B. atrophaeus*) | *B. atrophaeus* | DNA | Ba06596576_s1 |
| TaqMan ® Universal RNA Spike In/Reverse Transcription (Xeno) Control | Xeno | RNA | Ac00010014_a1 |
| Human RNase P RPPH1 gene | RPPH1 | DNA | Hs04930436_g1 |

In some embodiments, a panel of different qPCR assays can be used to test for multiple strains or types of pathogens in addition to SARS-CoV-2, including, but not limited to, other viral pathogens, such as Flu A and/or Flu B, and RSV Type A and/or Type B, bacterial pathogens, and/or fungal pathogens. In some embodiments, the panel of qPCR assays can be used simultaneously to test a single subject sample or a pooled sample comprising multiple subject samples, with each assay run in parallel in an array format. Optionally, different qPCR assays specific for each of the target nucleic acids can be plated into individual wells of a single array or multi-well plate, similar to, for example, a TaqMan Array Card (e.g., sold by Thermo Fisher Scientific under Catalog Nos. 4346800 and 4342265) or a MicroAmp multi-well reaction plate (e.g., sold by Thermo Fisher Scientific under Catalog Nos. 4346906, 4366932, 4306737, 4326659 and N8010560). Optionally, the different qPCR assays present in different wells of an array or plate can be dried or freeze-dried in situ and the array or plate can be stored or shipped prior to use. In some embodiments the array-formatted assays can be run as a singleplex or as a multiplex assay.

An exemplary array card disclosed herein can include some or all of the assays present in the TaqMan Array Respiratory Tract Microbiota Comprehensive Card (sold by Thermo Fisher Scientific under Catalog No. A41238), particularly those directed to identifying viral, bacterial, or fungal microbes from a sample, along with one or more assays for detecting SARS-CoV-2, as disclosed herein, present in at least one well of the array. The SARS-CoV-2 detection assays can include at least one primer or probe selected from SEQ ID NO:4-SEQ ID NO:2533.

In some embodiments, the panel includes assays for other circulating coronavirus strains, including but not limited to the 229E, KHU1, NL63, and OC43 coronaviruses. The panel/array card can include any number of individual assays, but in some embodiments, the panel/array card includes 48 separate assays, at least one of which is a control assay (e.g., RNase P, 18S rRNA, or the like). In some embodiments, the disclosed methods include using the panel to profile respiratory microorganisms present in a sample taken from an organism (e.g., human) and determining the profile of respiratory microbiota present in the organism's sample. Optionally, the disclosed methods can include diagnosing an infection present in an organism (e.g., human) from which a sample is taken.

In any of the foregoing embodiments, it should be appreciated that the compositions, kits, and methods for detecting viral nucleic acid can be implemented at or be included within a "point-of-service" (POS) system. Additionally, or alternatively, samples may be collected and/or analyzed at a "point-of-care" (POC) location. In some embodiments, analysis at a POC location typically does not require specialized equipment and has rapid and easy-to-read visual results. In some embodiments, analysis can be performed in the field, in a home setting, and/or by a lay person not having specialized skills. In certain embodiments, for example, the analysis of a small-volume clinical sample may be completed using a POS system in a short period of time (e.g., within hours or minutes).

Optionally, a "point of service" (POS) or a "point of service system," is performed at a location, using a system at that location, which is capable of providing a service (e.g. testing, monitoring, treatment, diagnosis, guidance, sample collection, verification of identity (ID verification), and other services) at or near the site or location of the subject. A service may be a medical service or may be a non-medical service. In some situations, a POS system provides a service at a predetermined location, such as a subject's home, school, or work, or at a grocery store, a drug store, a community center, a clinic, a doctor's office, a hospital, an outdoor triage tent, a makeshift hospital, a border check point, etc. A POS system can include one or more point of service devices, such as a portable virus/pathogen detector. In some embodiments, a POS system is a point of care system. In some embodiments, the POS system is suitable for use by non-specialized workers or personnel, such as nurses, police officers, civilian volunteers, or the subject herself.

In certain embodiments, the assays described herein can be performed at a "point of care" (POC), e.g., a location at which medical-related care (e.g. treatment, testing, monitoring, diagnosis, counseling, etc.) is provided. A POC may be, e.g. at a subject's home, work, or school, or at a grocery store, a community center, a drug store, a doctor's office, a clinic, a hospital, an outdoor triage tent, a makeshift hospital, a border check point, etc. A POC system is a system which may aid in, or may be used in, providing such medical-related care, and may be located at or near the site or location of the subject or the subject's health care provider (e.g. subject's home, work, or school, or at a grocery store, a community center, a drug store, a doctor's office, a clinic, a hospital, etc.).

In embodiments, such a system is a point-of-service system (POS system), wherein a POS system is located at a point of service location. In embodiments, a POS system is located at a point of service location and is configured to accept a clinical sample obtained from a subject at the POS location. In embodiments, a POS system is located at a point of service location and is configured to accept a clinical sample obtained from a subject at the POS location, and is further configured to analyze the clinical sample at the POS location. In embodiments, the clinical sample is a small volume clinical sample. In embodiments, the clinical sample is analyzed in a short period of time. In embodiments, the short period of time is determined with respect to the time at which sample analysis began. In embodiments, the short period of time is determined with respect to the time at which the sample was inserted into a device for the analysis of the sample. In embodiments, the short period of time is determined with respect to the time at which the sample was obtained from the subject.

In some embodiments, a POS can include the amplification-based methods, compositions and kits disclosed herein, including any of the described assays and/or assay panels. Such assays are contemplated for use with both thermal cycling amplification workflows and protocols, such as in PCR, as well as isothermal amplification workflows and protocols, such as in LAMP.

In some embodiments, a POS or a POC comprises self-collection of a biological sample, such as a nasal swab or a saliva sample. In some embodiments, the self-collection may comprise the use of a self-collection kit and/or device, such as a swab or a tube. In some embodiments, the self-collection kit comprises instructions for use, including collection instructions, sample preparation or storage instructions, and/or shipping instructions. For example, the self-collection kit and/or device may be used by an individual, such as lay person, not having specialized skills or medical expertise. In some embodiments, self-collection may be performed by the subject themselves or by any another individual in proximity to the subject, such as but not limited to a parent, a care giver, a teacher, a friend, or other family member.

The POS/POC implementations can beneficially provide a convenient way to monitor and/or detect individuals who may be infected by any of the viruses sought by the disclosed kits and methods. This includes, for example, screening for asymptomatic individuals (e.g., those individuals who are infected with SARS-CoV-2 and who may be shedding infectious virions prior to the presentation of the hallmark symptoms associated with respiratory tract infections (e.g., fever, coughing, malaise). Once detected, the infected individuals can be quarantined to prevent further spread of the infection. Additionally, or alternatively, the individual can be provided appropriate medical care, which in some embodiments can be initiated directly at the POC facility and/or following notification of a healthcare professional by the POS system/POC facility.

The disclosed kits and methods for detecting viral sequences beneficially provides companies and/or venues that are decentralized from hospitals and/or traditional clinical laboratory services with the ability to quickly screen samples on site and to take action where appropriate and with only those individuals where action should be taken. For example, spectators of a sporting event may arrive at the corresponding venue in advance of the event where they can be screened for SARS-CoV-2 (in addition to any other disclosed virus). Those spectators who test negative may then enter the venue and may not be required to practice social distancing or to wear personal protective equipment, such as wearing a face covering. On the other hand, those spectators who test positive can be rejected entry and directed to a healthcare professional, thereby limiting the exposure and/or spread of SARS-CoV-2 (or other virus detected by the disclosed kits and methods disclosed herein) at the venue.

Because the disclosed kits and methods enable screening of individuals at locations that are decentralized from hospitals and/or traditional clinical laboratory services, the disclosed kits and/or methods can additionally be used to collect accurate epidemiological data from a population more efficiently and more quickly. Such data can be used to identify hot spots within a community and/or behaviors or cohorts that perpetuate the spread of such viral pathogens, which can enable directed or more effective solutions.

When conducting screenings, as discussed above, the samples from individuals who report to be healthy (i.e., asymptomatic for the hallmarks of SARS-CoV-2, or other respiratory tract, infection) can be combined into a single pooled sample. Because most of the samples are expected to be negative, such methods can beneficially enable the screening of large populations quickly and efficiently, though it may require a minority of people to be retested to determine which sample(s) in a given pooled sample is responsible for the pooled sample testing positive for the presence of the target nucleic acid (e.g., SARS-CoV-2). Less assay resources and/or instruments would be required to process each sample separately and/or the same amount of assay resources and/or instruments can be used to screen a larger number of samples.

That is, in some embodiments, a sample is obtained from multiple organisms (e.g., a plurality of subjects or patients) and the multiple samples are pooled together to make a single pooled sample for testing. A sample may be obtained from at least two different organisms or individuals for pooling together to form a single pooled sample for testing. In some embodiments, a sample may be obtained from between 2-10 different organisms or individuals and pooled together to form a single sample for testing. In some embodiments, a sample may be obtained from 2, 3, 4, 5, 6, 7, 8, 9, or 10 different organisms or individuals for pooling together to form a single sample for testing. In some embodiments, a sample may be obtained from up to and including 5 different organisms or individuals for pooling together to form a single sample for testing. For example, a sample used for testing, according to the methods and compositions described herein, may comprise a multiplicity of samples obtained from different organisms or individuals (e.g. 2, 3, 4, 5 different individuals) which are combined together to form a single samples used for subsequent detection of a pathogen such as SARS-CoV-2.

Regardless of whether the samples are pooled or evaluated individually, the inventors have unexpectedly discovered that mixing RT-qPCR reaction volumes can play a critical role in preventing optical mixing and/or the false classification of samples. Accordingly, a step of mixing (e.g., vortexing) the reaction volume prior to RT-qPCR is included in preferred methods for detecting viral sequences disclosed herein. This can include, for example, vortexing the reaction volume (e.g., single tube, array, and/or plate-based). In some embodiments, the reaction volume is vortexed for at least 5 seconds, preferably at least 10 seconds. In some embodiments, the reaction volume is vortexed for about one minute or longer, preferably less than about one minute, or more preferably less than about 30 seconds. In some embodiments, the reaction volume is vortexed for a period of time between 5 seconds and about one minute, preferably between 10-30 seconds.

Abbreviated List of Defined Terms

To assist in understanding the scope and content of the foregoing and forthcoming written description and appended claims, a select few terms are defined directly below.

The SARS-CoV-2 virus, also known as 2019-nCoV, is associated with the human respiratory disease COVID-19. The virus isolated from early cases of COVID-19 was provisionally named 2019-nCoV, and the Coronavirus Study Group of the International Committee on Taxonomy of Viruses subsequently designated 2019-nCoV as SARS-CoV-2. For the purposes of this disclosure, the term "SARS-CoV- 2" and "2019-nCoV" are considered to refer to the same virus and may be used interchangeably to refer to the etiologic agent for COVID-19. As used herein, these terms are also inclusive of separate variants of SARS-CoV-2, including variant B.1.1.7, variant 501Y.V2, and other variants that may emerge in the future.

As used herein, the term "kit" refers to any delivery system for delivering materials. In the context of reaction assays, such delivery systems include systems that allow for the storage, transport, or delivery of reaction reagents (e.g., oligonucleotides, enzymes, primer set(s), etc. in the appropriate containers) and/or supporting materials (e.g., buffers, written instructions for performing the assay etc.) from one location to another. For example, kits can include one or more enclosures (e.g., boxes) containing the relevant reaction reagents and/or supporting materials. As used herein, the term "fragmented kit" refers to a delivery system comprising two or more separate containers that each contain a sub-portion of the total kit components. The containers may be delivered to the intended recipient together or separately. For example, a first container may contain an enzyme for use in an assay, while a second container contains oligonucleotides. Indeed, any delivery system comprising two or more separate containers that each contains a sub-portion of the total kit components are included in the term "fragmented kit." In contrast, a "combined kit" refers to a delivery system containing all of the components of a reaction assay in a single container (e.g., in a single box housing each of the desired components). The term "kit" includes both fragmented and combined kits.

Components described herein may be combined with one another and provided as such a combined kit or fragmented kit, or alternatively each component may be provided separately and utilized as desired by a user. For example, a treatment solution as described herein may be included in a kit or may be provided as a "stand-alone" item (in an appropriate container) for use as desired by the user.

As used herein, the term "patient" generally refers to any animal, for example a mammal, under the care, observation, or treatment of a healthcare provider, with particular reference to humans under the care of a primary care physician, infectious disease specialist, or other relevant medical professional that may diagnose or treat viral infections. For the purpose of the present application, a "patient" may be interchangeable with an "individual" or "subject." Accordingly, in some embodiments, the subject is a human patient. It should be appreciated, however, that a "subject" does not necessarily have to be a "patient," as that term is described herein. For example, a subject may be an asymptomatic carrier or uninfected person (or animal) being screened for one or more viruses. A "subject" can also be a non-human animal, such as a mink.

As used herein, the terms "real-time PCR" or "quantitative real-time PCR" or "qPCR" refer to the measurable amplification of nucleic acids via PCR in real time, typically by monitoring fluorescent probes in the reaction volume and enabling the optional quantitation of the PCR product. The terms "real-time" and "real-time continuous" are interchangeable and refer to a method where data collection occurs through periodic monitoring during the course of the amplification reaction. Thus, real-time methods combine amplification and detection into a single step. It should be appreciated that the data collection may occur through periodic monitoring during the course of PCR while the analysis of such data may occur later in time.

The terms "reverse transcription PCR" or simply "RT-PCR" are intended to include those PCR methods that first transcribe an RNA template (such as a viral RNA genomic template) into complementary DNA (cDNA) using an RNA-dependent DNA polymerase generally referred to as a reverse transcriptase. The cDNA is then used by any of the DNA-dependent DNA polymerases commonly used in PCR methods as a template for PCR amplification of the target nucleic acid sequence. For ease of use within the specification, the terms "RT-PCR" and "RT-qPCR" may be used interchangeably, as it is understood by those having skill in the art that methods and reagents for monitoring amplicon production at the endpoint, such as is done in traditional PCR methods, can be adjusted such that amplicon production can be monitored during and/or between thermal cycles of PCR, such as is done in traditional qPCR methods.

Further, it should be appreciated that when the term "qPCR" is used herein, it does not necessarily exclude methods and/or kits that include an initial reverse transcription step. As such, any indication within the specification of a "qPCR" method, kit, array, and/or assay for performing qPCR is understood to include the same or similar method, kit, array, and/or assay having an initial reverse transcription step with any attendant reagents (e.g., reverse transcriptase, buffers, dNTPs, salts, etc.).

Unless defined otherwise, all technical and scientific terms used herein have the same meaning as commonly understood by one of ordinary skill in the art to which the present disclosure pertains.

Various aspects of the present disclosure, including devices, systems, and methods may be illustrated with reference to one or more embodiments or implementations, which are exemplary in nature. As used herein, the term "exemplary" means "serving as an example, instance, or illustration," and should not necessarily be construed as preferred or advantageous over other embodiments disclosed herein. In addition, reference to an "implementation" of the present disclosure or invention includes a specific reference to one or more embodiments thereof, and vice versa, and is intended to provide illustrative examples without limiting the scope of the invention, which is indicated by the appended claims rather than by the following description.

As used throughout this application the words "can" and "may" are used in a permissive sense (i.e., meaning having the potential to), rather than the mandatory sense (i.e., meaning must). Additionally, the terms "including," "having," "involving," "containing," "characterized by," as well as variants thereof (e.g., "includes," "has," "involves," "contains," etc.), and similar terms as used herein, including within the claims, shall be inclusive and/or open-ended, shall have the same meaning as the word "comprising" and variants thereof (e.g., "comprise" and "comprises"), and do not exclude additional un-recited elements or method steps, illustratively.

It will be noted that, as used in this specification and the appended claims, the singular forms "a," "an" and "the" include plural referents unless the context clearly dictates otherwise. Thus, for example, reference to a singular referent (e.g., "widget") includes one, two, or more referents. Similarly, reference to a plurality of referents should be interpreted as comprising a single referent and/or a plurality of referents unless the content and/or context clearly dictate otherwise. For example, reference to referents in the plural form (e.g., "widgets") does not necessarily require a plurality of such referents. Instead, it will be appreciated that independent of the inferred number of referents, one or more referents are contemplated herein unless stated otherwise.

To facilitate understanding, like reference numerals (i.e., like numbering of components and/or elements) have been used, where possible, to designate like elements common to the figures. Specifically, in the exemplary embodiments illustrated in the figures, like structures, or structures with like functions, will be provided with similar reference designations, where possible. Specific language will be used herein to describe the exemplary embodiments. Nevertheless, it will be understood that no limitation of the scope of the disclosure is thereby intended. Rather, it is to be understood that the language used to describe the exemplary embodiments is illustrative only and is not to be construed as limiting the scope of the disclosure (unless such language is expressly described herein as essential).

Any headings used herein are for organizational purposes only and are not meant to be used to limit the scope of the description or the claims.

Various aspects of the present disclosure can be illustrated by describing components that are bound, coupled, attached, connected, and/or joined together. As used herein, the terms "bound," "coupled", "attached", "connected," and/or "joined" are used to indicate either a direct association between two components or, where appropriate, an indirect association with one another through intervening or intermediate components. In contrast, when a component is referred to as being "directly bound," "directly coupled", "directly attached", "directly connected," and/or "directly joined" to another component, no intervening elements are present or contemplated. Furthermore, binding, coupling, attaching, connecting, and/or joining can comprise mechanical and/or chemical association.

EXAMPLES

Example 1: Singleplex Assay for Detecting SARS-CoV-2

An exemplary protocol for detecting SARS-CoV-2 from a biological sample via a singleplex assay was performed, as The assay used primers and FAM-labeled probes for detecting the ORF1ab, as well as additional primers and process for detecting S protein, and N protein coding sequences for SARS-CoV-2 selected from the primers and probes disclosed herein. The assay also used general-purpose components (e.g., master mix and other non-oligonucleotide components) from TaqMan 2019-nCoV Assay Kit (Thermo Fisher Scientific, Catalog No. A47532). An optional VIC-labeled internal control directed to RNase P was also included. In a separate kit, the same primers/probes were included and used as positive controls to detect the target sequences from a synthetic DNA construct encoding the target sequences for ORF1ab, S protein, N protein, and RNase P.

The total nucleic acid content was isolated from samples collected via nasopharyngeal swab, nasopharyngeal aspirate, or bronchoalveolar lavage using the MagMAX Viral/Pathogen Nucleic Acid Isolation Kit (sold by Thermo Fisher Scientific under Cat. No. A42356) in accordance with the instructions provided therewith.

For each assay, the components in Table 4 were combined for the number of reactions, plus 10% overage:

TABLE 4

RT-qPCR Reaction Mix

| Component | Volume/reaction |
|---|---|
| RT-qPCR Master Mix, CG (4X) | 6.25 µL |
| 2019 nCoV TaqMan Assay (20X) (FAM) | 1.25 µL |
| TaqMan RNase P Assay, VIC dye/QSY assay (20X) | 1.25 µL |
| Nuclease-free water | 11.25 µL |
| Total Reaction Mix Volume | 20.00 µL |

The reaction mixes were vortexed for about 10-30 seconds and centrifuged briefly. For each reaction, the components in Table 5, below, were combined in a MicroAmp Optical 96-Well Reaction Plate (0.2 mL/well):

TABLE 5

RT-qPCR Reactions

| Component | Volume/reaction |
|---|---|
| Reaction Mix (see Table 4) | 20.00 µL |
| Nucleic acid sample or<br>1 µL 2019-nCoV Control construct + 4 µL<br>PCR-grade water or<br>No template control (5 µL PCR-grade water) | 5.00 µL |
| Total Reaction Volume | 25.00 µL |

The plate was sealed with a MicroAmp Optical Adhesive Film and vortexed briefly to mix the contents. The plate was centrifuged briefly to collect the contents at the bottom of the wells. The plate was loaded into a 7500 Real-Time PCR Instrument and the protocol in either Table 6 or Table 7 was run, depending on the respective RT-qPCR Master Mix used to create the reaction mix.

TABLE 6

RT-qPCR Protocol using TaqPath 1-Step RT-qPCR Master Mix
RT-qPCR Protocol
TaqPath 1-Step RT-qPCR Master Mix

| Step | Stage | # of cycles | Temp. | Time |
|---|---|---|---|---|
| UNG incubation | 1 | 1 | 25° C. | 2 min |
| Reverse transcription[†] | 2 | 1 | 50° C.[†] | 15 min |
| Polymerase activation[‡] | 3 | 1 | 95° C.[‡] | 2 min |
| Amplification | 4 | 40 | 95° C. | 3 sec |
| | | | 60° C. | 30 sec |

[†]Preferably any temperature between 48° C.-55° C.
[‡]RT inactivation, initial denaturation, and activation of DNAP.

TABLE 7

RT-qPCR Protocol using TaqMan Fast Virus 1-Step Master Mix
RT-qPCR Protocol
TaqMan Fast Virus 1-Step Master Mix

| Step | Stage | # of cycles | Temp. | Time |
|---|---|---|---|---|
| Reverse transcription | 1 | 1 | 50° C.[†] | 5 min |
| RT inactivation/initial Denaturation | 2 | 1 | 95° C. | 20 sec |
| Amplification | 3 | 40 | 95° C. | 3 sec |
| | | | 60° C. | 30 sec |

[†]Preferably any temperature between 48° C.-55° C.

The resulting data were analyzed using the included 7500 Software v2.3 because this program has updated algorithms with improved sensitivity for detecting low-copy samples.

The analysis was performed using the Auto Baseline and Auto Threshold analysis settings of the aforementioned software. For each plate, the control reactions were confirmed to perform as expected (i.e., the no template control had an undetermined $C_t$ value and the positive control had a $C_t$ value less than or equal to 30).

The $C_t$ value for each individual assay was also analyzed in accordance with Table 8.

TABLE 8

Individual assay results guide

| 2019-nCoV assay (FAM) | RNase P assay (VIC) | Interpreted Result |
|---|---|---|
| $C_t < 37$ | Any Value | Positive. |
| $37 \leq C_t < 40$ | Any Value | Inconclusive. Repeat the test. |
| $C_t = 40$ or undetermined | $C_t < 40$ | Negative. |

The results for each tested sample was interpreted to have SARS-CoV-2 RNA present if either (i) any two of the three 2019-nCoV assays were positive or (ii) any one of the 2019-nCoV assays were positive in two different samples collected from the same subject. SARS-CoV-2 RNA was not present in the sample if all three of the 2019-nCoV assays were negative.

Figure 2A:
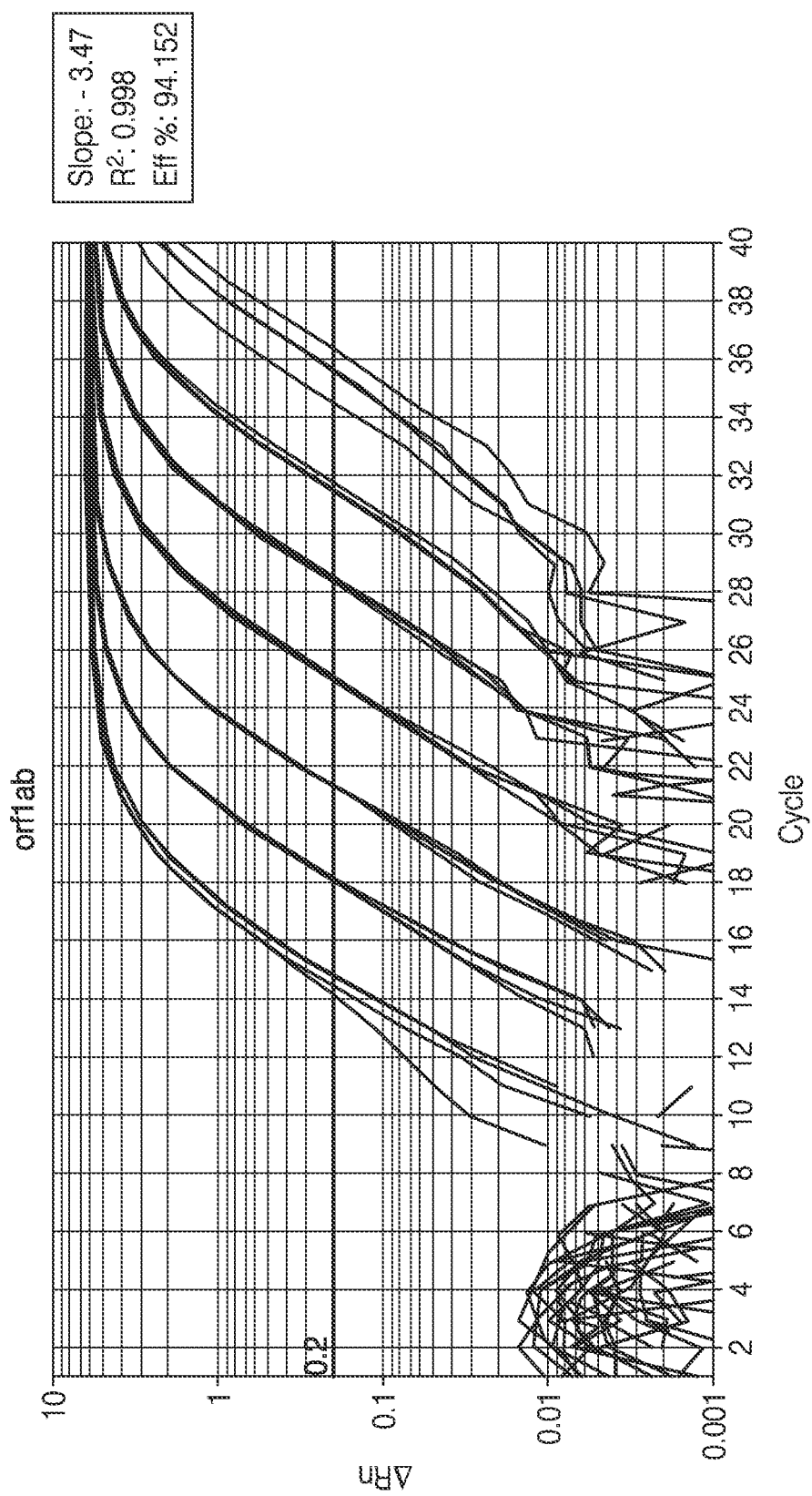
FIG. 2A illustrates the amplification plot of an ORF1ab singleplex qPCR assay performed on an exemplary sample containing SARS-CoV-2 nucleic acid, the reagents for the qPCR assay being part of a kit for the detection of SARS-CoV-2 disclosed herein.
Figure 2B:
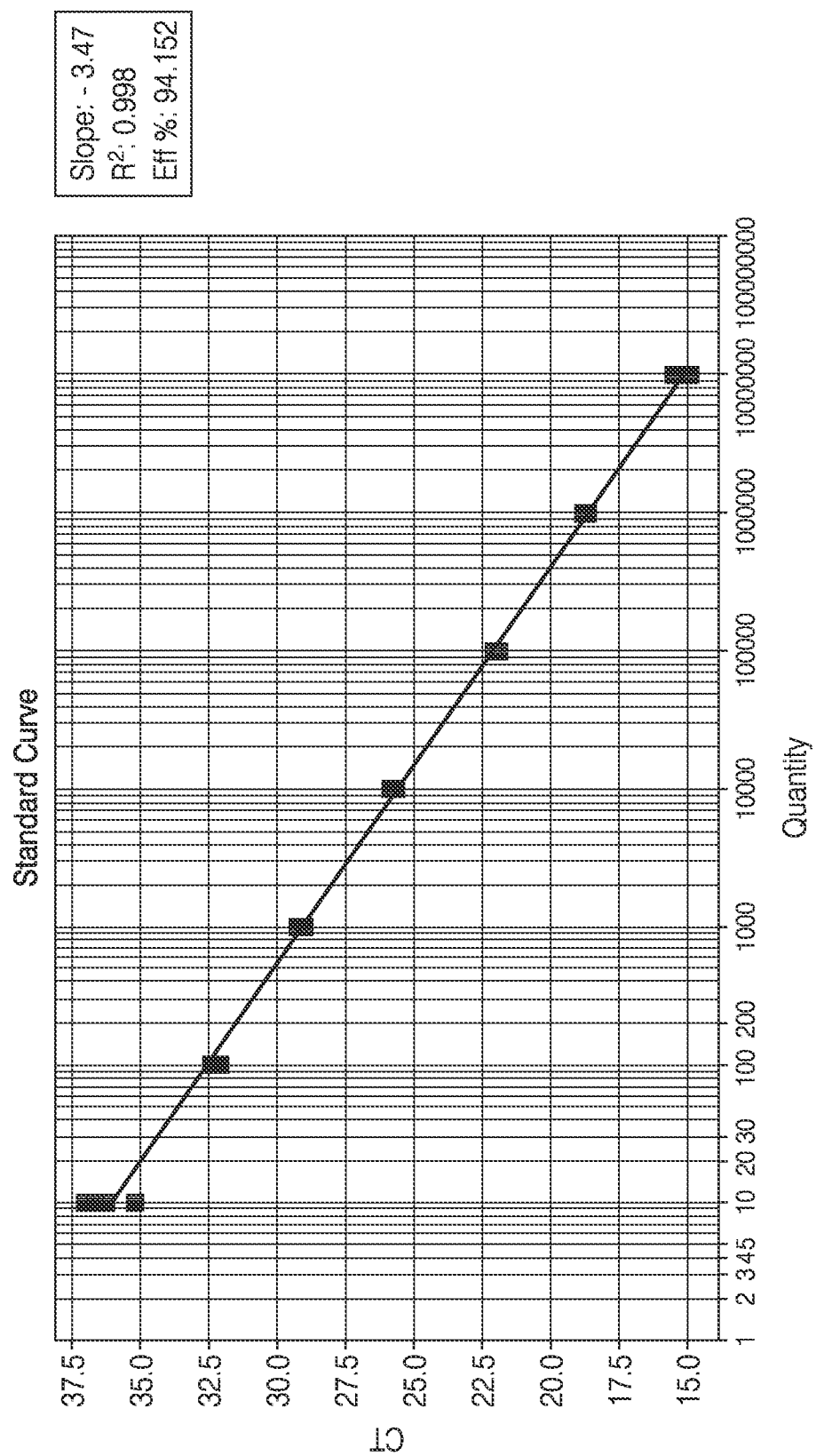
FIG. 2B illustrates the standard curve for the singleplex qPCR assay of FIG. 2A.
Figure 2C:
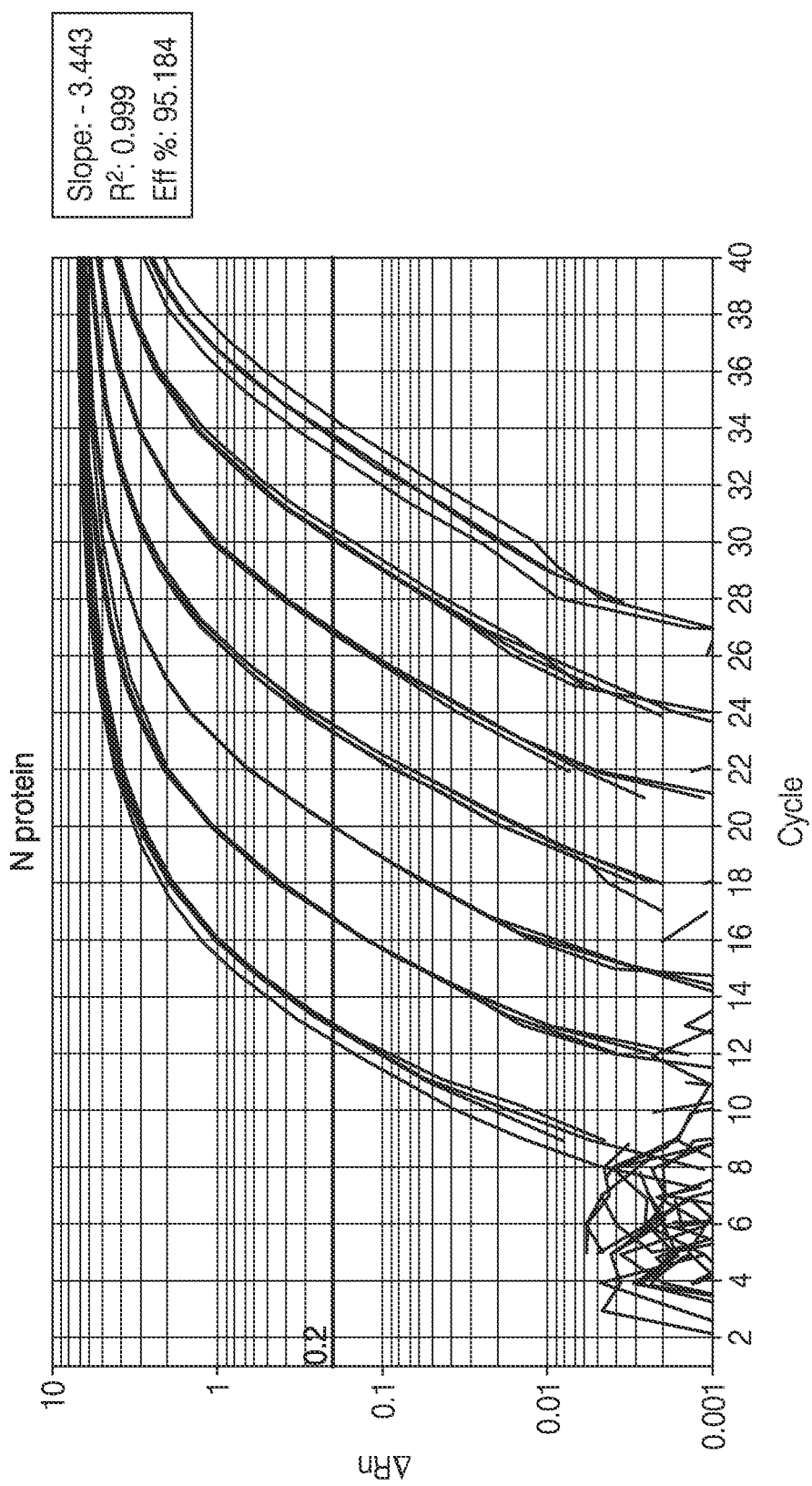
FIG. 2C illustrates the amplification plot of an N protein singleplex qPCR assay performed on an exemplary sample containing SARS-CoV-2 nucleic acid, the reagents for the qPCR assay being part of a kit for the detection of SARS-CoV-2 disclosed herein.
Figure 2D:
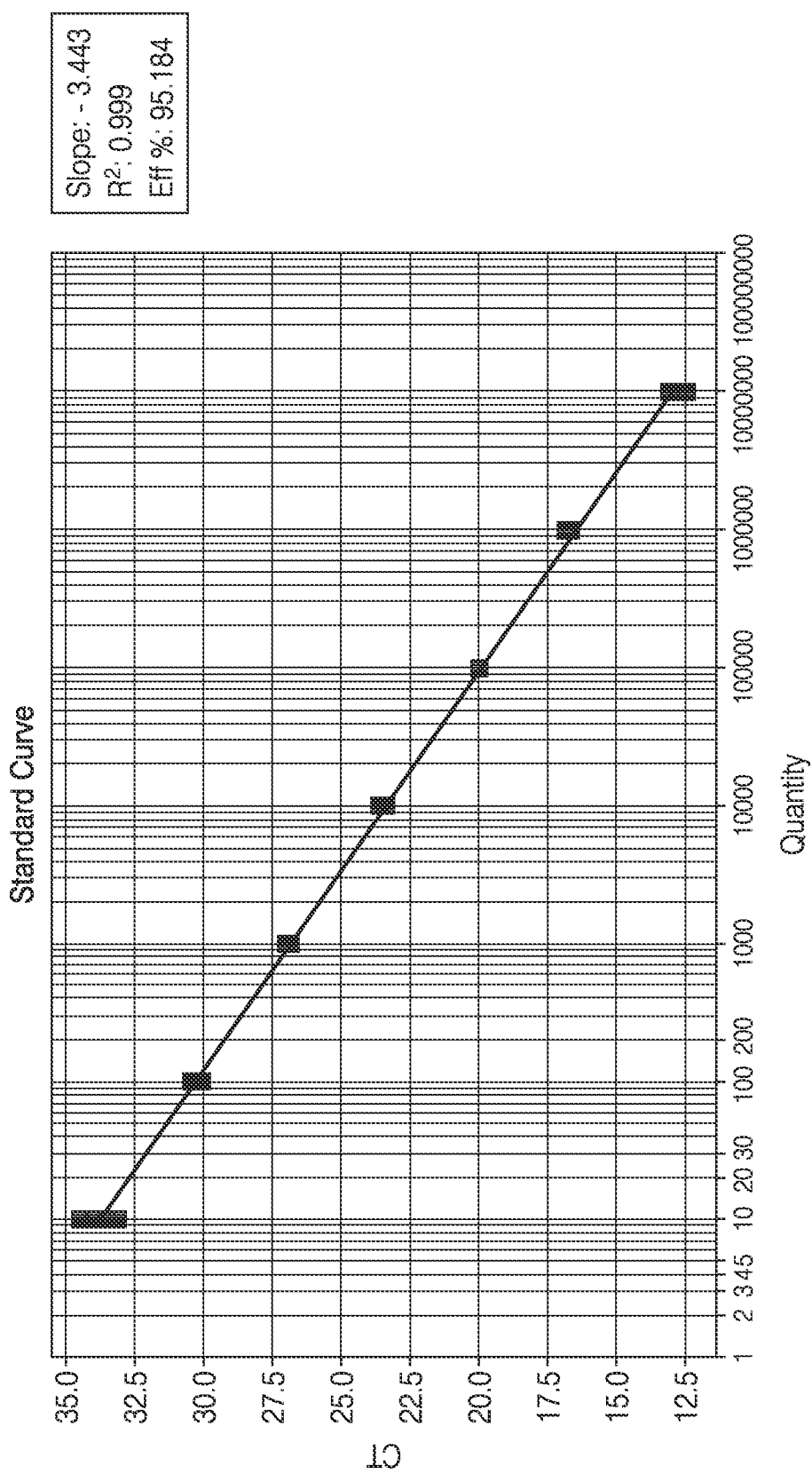
FIG. 2D illustrates the standard curve for the singleplex qPCR assay of FIG. 2C.
Figure 2E:
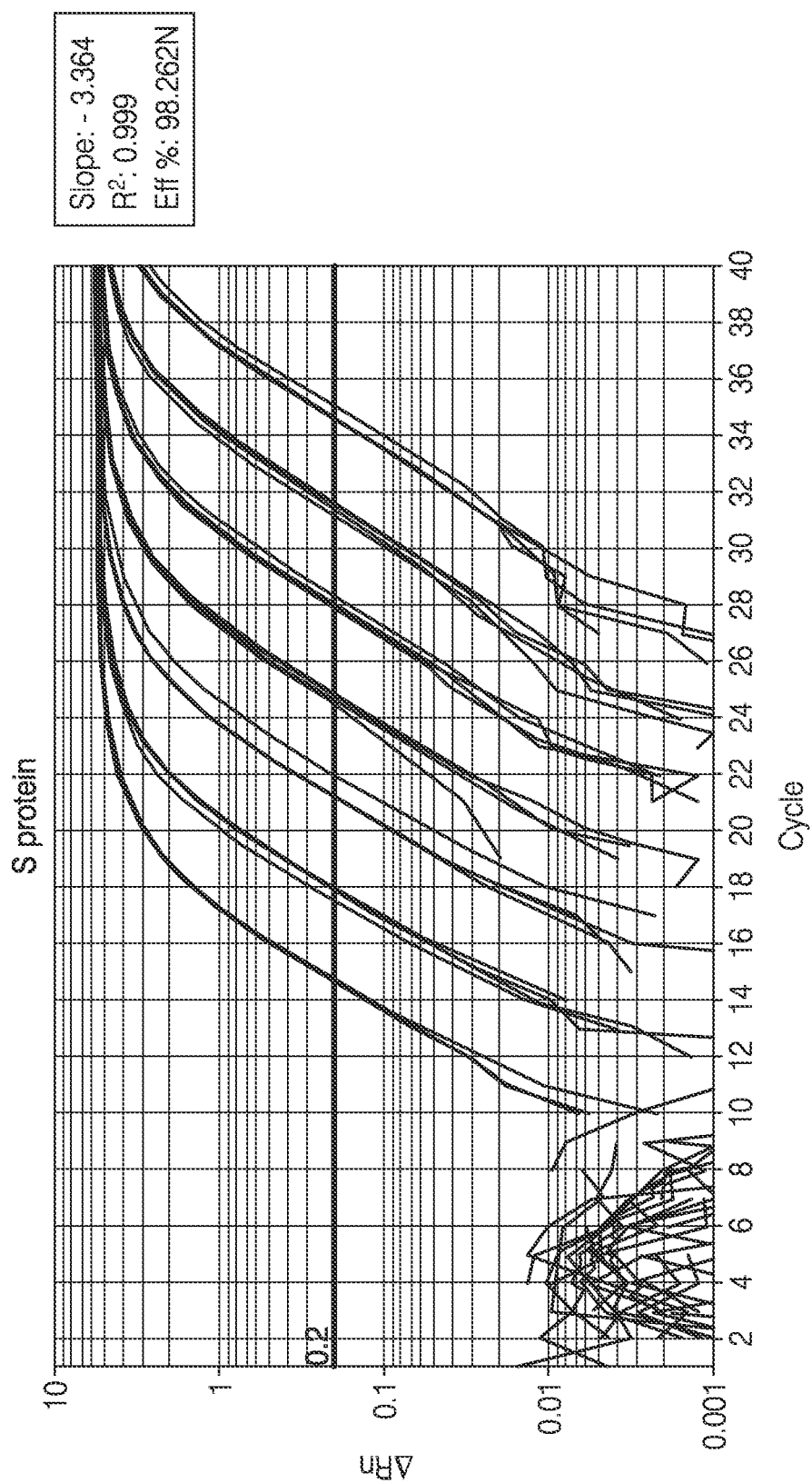
FIG. 2E illustrates the amplification plot of an S protein singleplex qPCR assay performed on an exemplary sample containing SARS-CoV-2 nucleic acid, the reagents for the qPCR assay being part of a kit for the detection of SARS-CoV-2 disclosed herein.
Figure 2F:
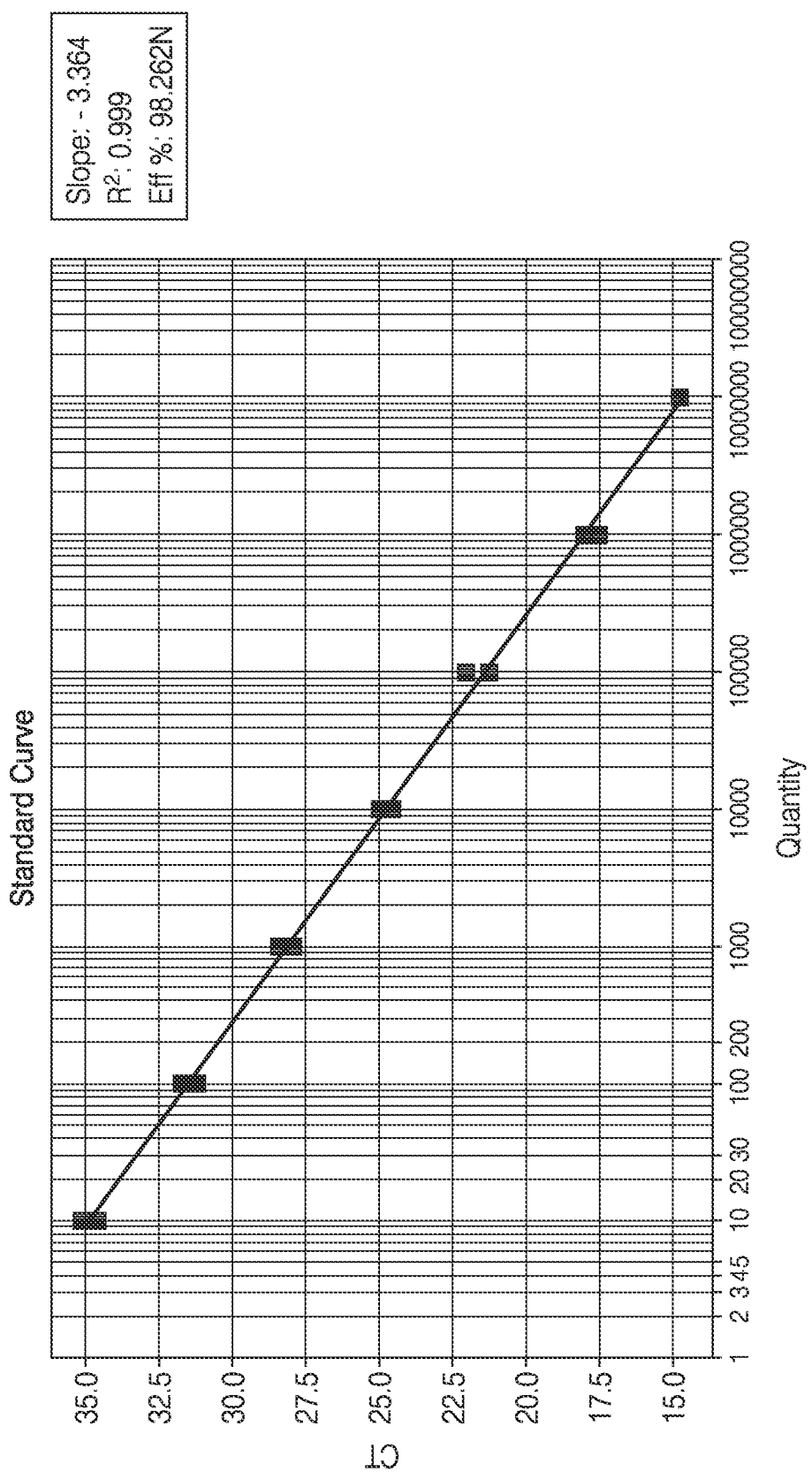
FIG. 2F illustrates the standard curve for the singleplex qPCR assay of FIG. 2E.

Exemplary results illustrating amplification plots and associated standard curves for ORF1ab are provided in FIGS. 2A and 2B, respectively. Similarly, an amplification plot and associated standard curve for S protein are provided in FIGS. 2C and 2D, respectively, and an amplification plot and associated standard curve for N protein are provided in FIGS. 2E and 2F, respectively.

Example 2: Multiplex Assay for Detecting SARS-CoV-2

An exemplary protocol for detecting SARS-CoV-2 from a biological sample via a multiplex assay was performed. The assay kit included primers and FAM-labeled probes for detecting ORF1ab (SEQ ID NOs: 160, 468 and 1049, respectively), primers and ABY-labeled probes for detecting S protein (SEQ ID NOs: 100, 337 and 864, respectively), and primers and VIC-labeled probes for detecting N protein (SEQ ID NOs: 211, 501 and 833, respectively) coding sequences for SARS-CoV-2. A JUN-labeled internal positive control directed to either endogenous RNase P or an exogenous MS2 RNA template was also included. In a separate kit, the same primers/probes were included and used as positive controls to detect the target sequences from a synthetic DNA construct encoding the target sequences for ORF1ab, S protein, N protein, and RNase P/MS2 RNA. The remaining amplification reagents were obtained from the TaqPath™ COVID-19 Combo kit (Thermo Fisher Scientific, Catalog No. A47814).

The total nucleic acid content was isolated from samples collected via nasopharyngeal swab, nasopharyngeal aspirate, or bronchoalveolar lavage using the MagMAX Viral/Pathogen Nucleic Acid Isolation Kit (sold by Thermo Fisher Scientific under Cat. No. A42356) in accordance with the instructions provided therewith.

For each assay, the components in Table 9 were combined for the number of reactions, plus 10% overage:

TABLE 9

RT-qPCR Reaction Mix

| Component | Volume/reaction |
|---|---|
| TaqPath 1-Step Multiplex Master Mix, CG (4X) | 6.25 µL |
| nCoV Multiplex TaqMan Assay (20X) | 1.25 µL |
| Internal positive control template | 1.00 µL |
| Nuclease-free water | 11.50 µL |
| Total Reaction Mix Volume | 20.00 µL |

The reaction mixes were vortexed for about 10-30 seconds and centrifuged briefly. For each reaction, the components in Table 10, below, were combined in a MicroAmp Optical 96-Well Reaction Plate (0.2 mL/well):

TABLE 10

RT-qPCR Reactions

| Component | Volume/reaction |
|---|---|
| Reaction Mix (see Table 4) | 20.00 µL |
| Nucleic acid sample or 1 µL 2019-nCoV Control construct + 4 µL PCR-grade water or No template control (5 µL PCR-grade water) | 5.00 µL |
| Total Reaction Volume | 25.00 µL |

The plate was sealed with a MicroAmp Optical Adhesive Film and vortexed briefly to mix the contents. The plate was centrifuged briefly to collect the contents at the bottom of the wells. reaction mixes were vortexed for about 10-30 seconds) and centrifuged briefly. The plate was loaded into a QuantStudio 5 Real-Time PCR System and the protocol in Table 11 was run.

TABLE 11

RT-qPCR Protocol for Multiplex Assay

| Step | Stage | # of cycles | Temp. | Time |
|---|---|---|---|---|
| UNG incubation | 1 | 1 | 25° C. | 2 min |
| Reverse transcription[†] | 2 | 1 | 50° C.[†] | 15 min |
| Polymerase activation[‡] | 3 | 1 | 95° C.[‡] | 2 min |
| Amplification | 4 | 40 | 95° C. | 3 sec |
| | | | 60° C. | 30 sec |

[†]Preferably any temperature between 48° C.-55° C.
[‡]RT inactivation, initial denaturation, and activation of DNAP.

The resulting data were analyzed using the QuantStudio Design and Analysis Software v1.5.1 included with the QuantStudio 5 Real-Time PCR System because this program has updated algorithms with improved sensitivity for detecting low-copy samples. For each plate, the control reactions were confirmed to perform as expected (i.e., the no template control had an undetermined $C_t$ value and the positive control had a $C_t$ value less than or equal to 30).

The $C_t$ value for each individual assay was also analyzed in accordance with Table 8.

TABLE 12

Individual assay multiplex assay results guide

| | Ct < 37 | 37 ≤ Ct < 40 | Ct = 40 or undetermined |
|---|---|---|---|
| ORF 1ab (FAM) | Positive | Repeat test | Negative |
| N protein (VIC) | Positive | Repeat test | Negative |

TABLE 12-continued

Individual assay multiplex assay results guide

|  | Ct < 37 | 37 ≤ Ct < 40 | Ct = 40 or undetermined |
|---|---|---|---|
| S protein (ABY) | Positive | Repeat test | Negative |
| Pos. Control (JUN) | Positive | Positive | Negative |

The results for each tested sample was interpreted to have SARS-CoV-2 RNA present if either (i) any two of ORF1ab, S protein, or N protein were positive or (ii) any one of ORF1ab, S protein, or N protein were positive in two different samples collected from the same subject. SARS-CoV-2 RNA was not present in the sample if all three of ORF1ab, S protein, and N protein were negative.

Example 3: Robustness Testing of SARS-CoV-2 Detection Assays

Figure 3A:
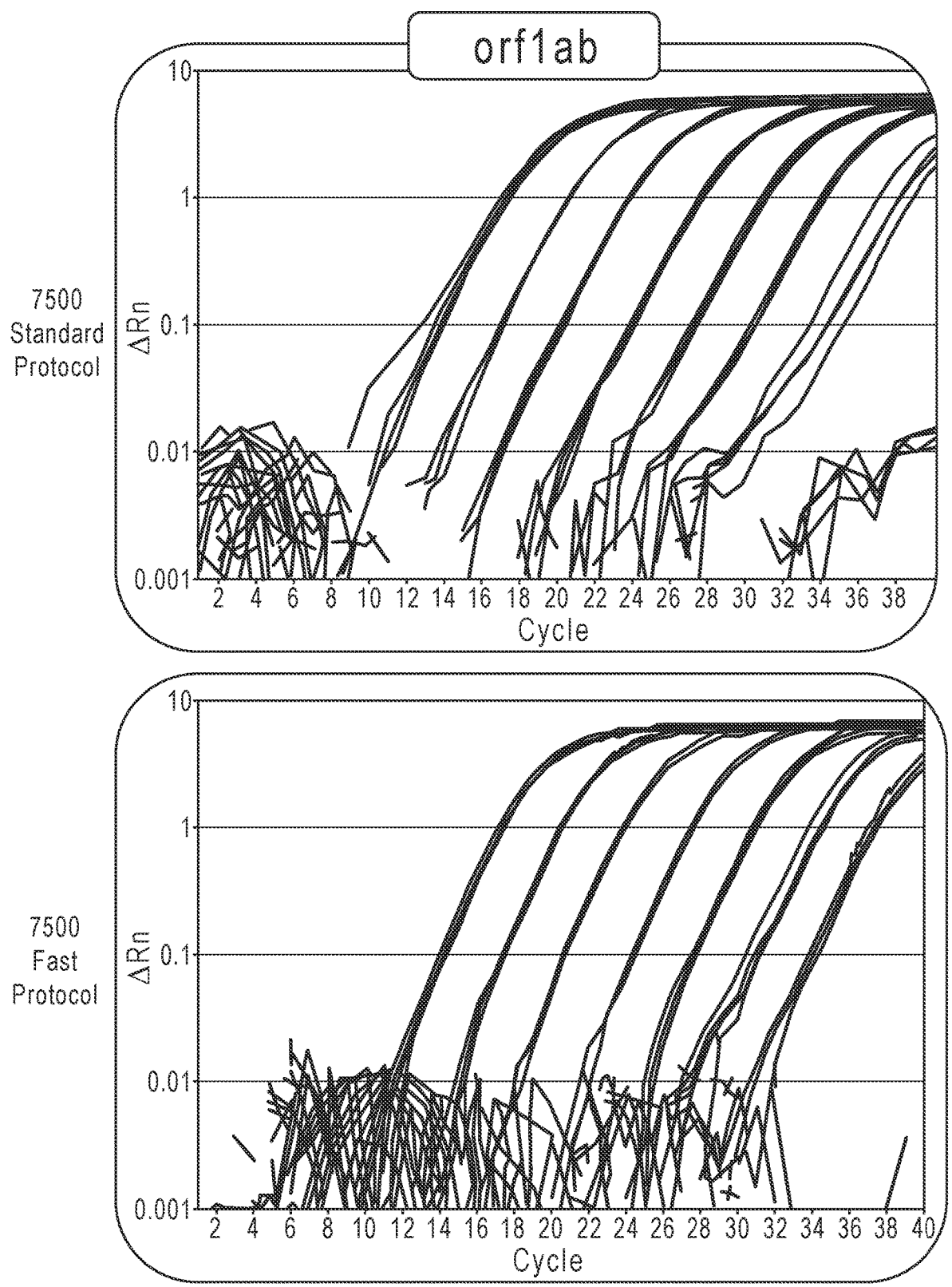
FIGS. 3A-3C illustrate comparative amplification plots of ORF1ab (FIG. 3A), N protein (FIG. 3B), and S protein (FIG. 3C) qPCR assays performed on a 7500 Fast Dx instrument (Thermo Fisher Scientific) running the 7500 Standard Protocol or the 7500 Fast Protocol.
Figure 3B:
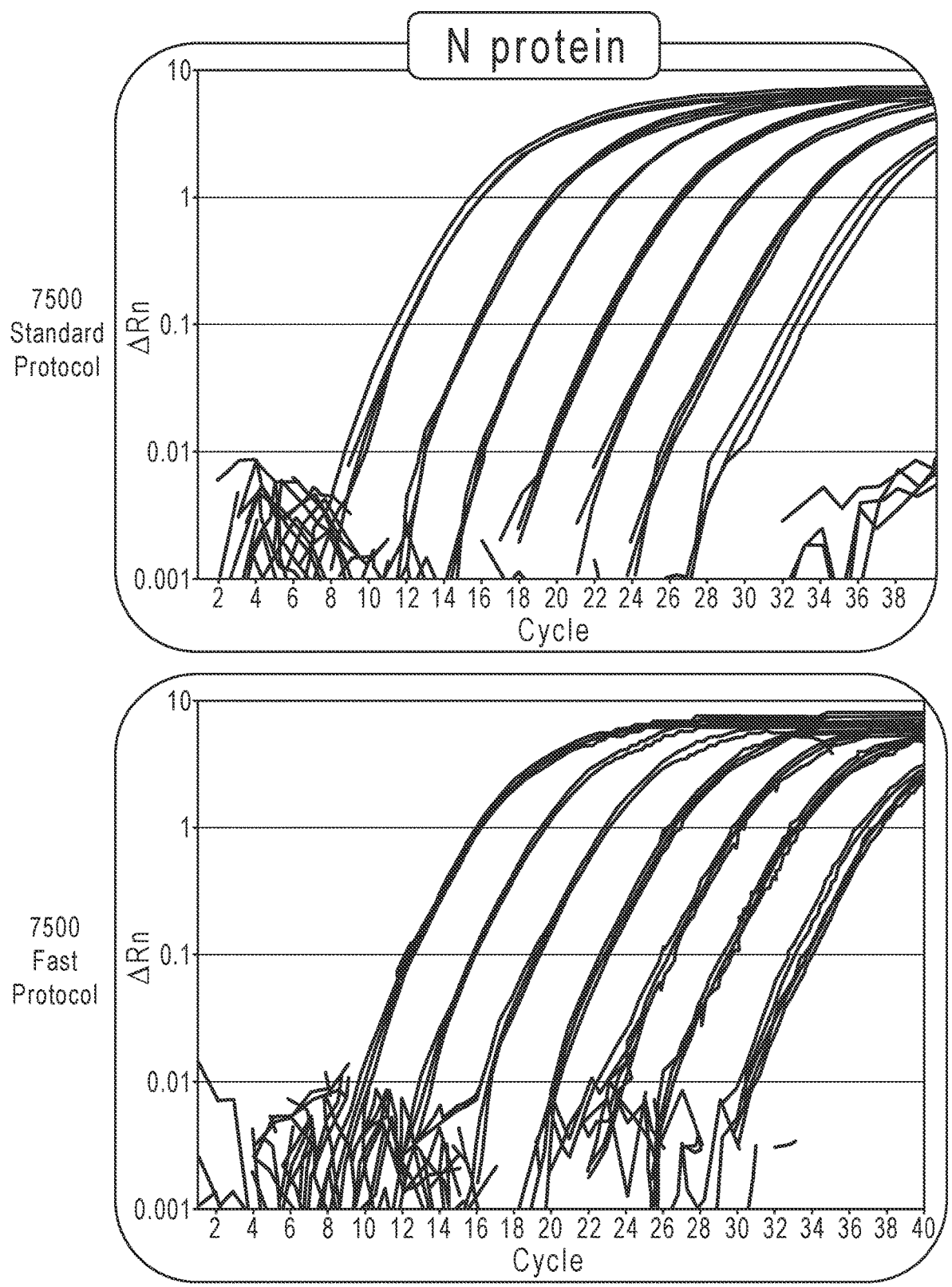
Figure 3C:
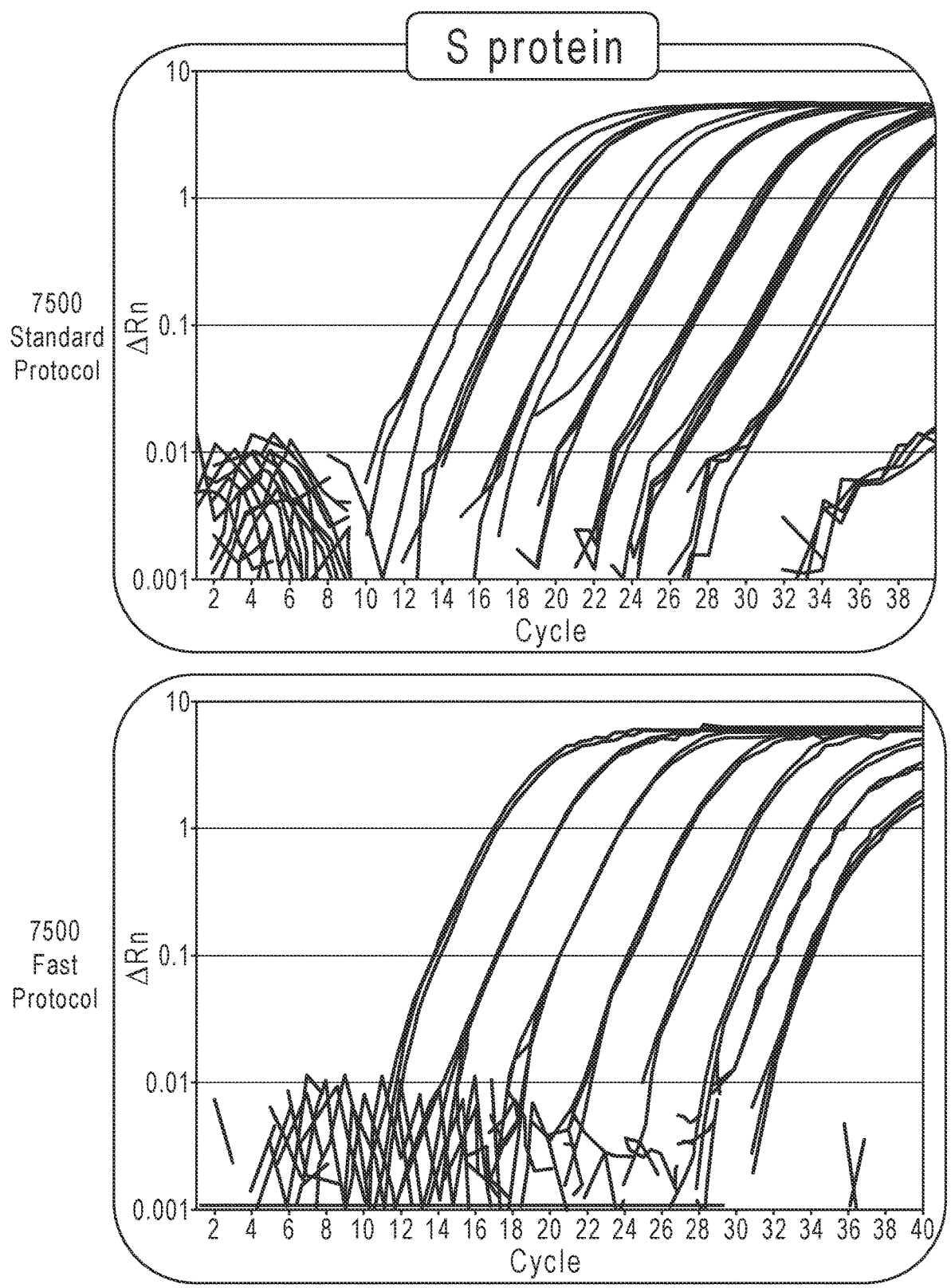

To ensure the specificity observed when performing the singleplex and multiplex assays described in Examples 1 and 2, the robustness of each assay was tested based on RT-qPCR protocol, qPCR instrument, and RT-qPCR master mix used. Exemplary results shown in FIGS. 3A-3C illustrate robust assay performance under both the 7500 Standard Protocol and the 7500 Fast Protocol and indicate that either protocol can be used effectively to identify samples with SARS-CoV-2 RNA.

Figure 4A:
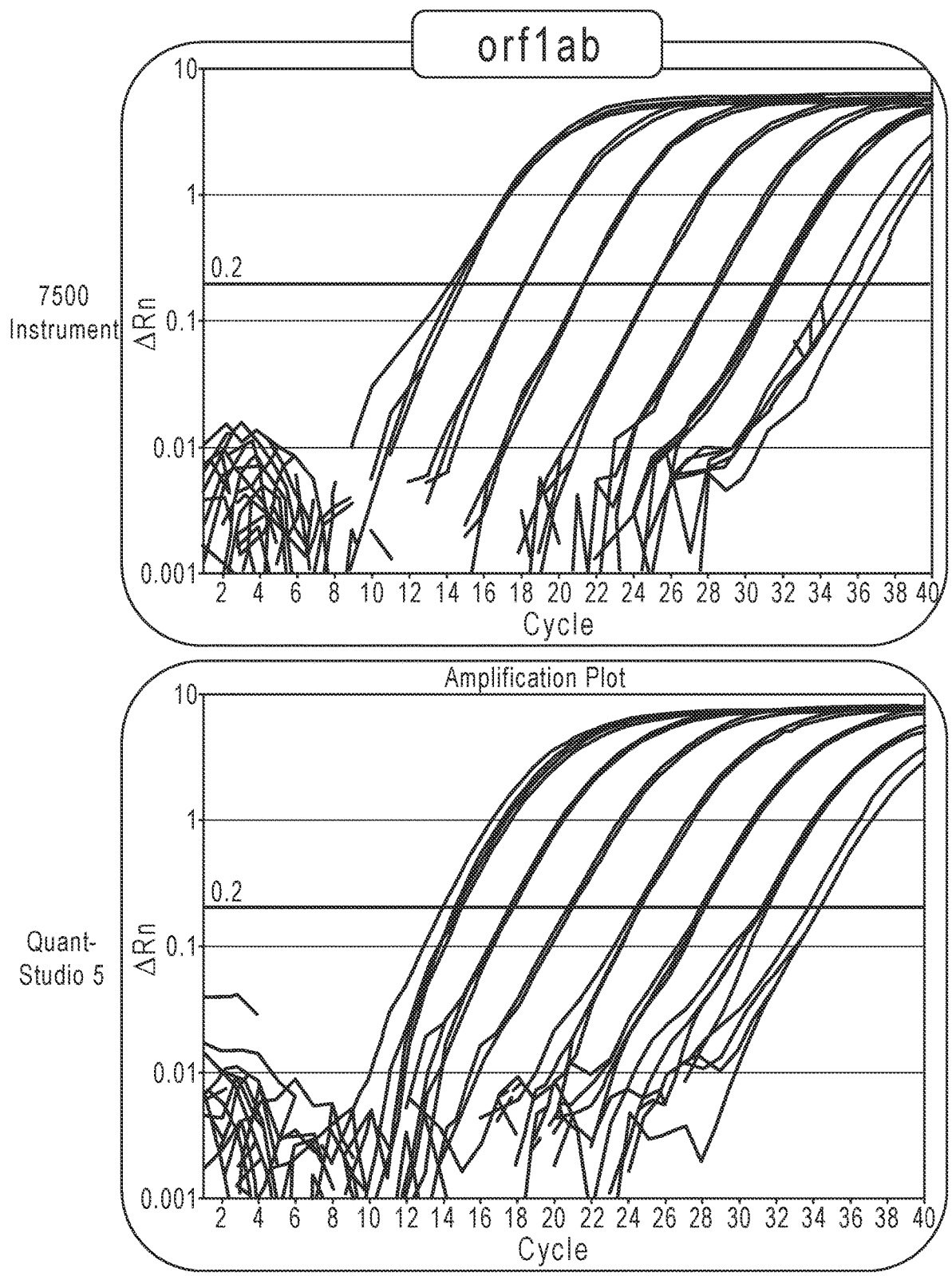
FIGS. 4A-4C illustrate comparative amplification plots of ORF1ab (FIG. 4A), N protein (FIG. 4B), and S protein (FIG. 4C) qPCR assays generated when running identical standard protocols on a 7500 Fast Dx instrument (Thermo Fisher Scientific) or a QuantStudio 5 Real-Time PCR System (Thermo Fisher Scientific).
Figure 4B:
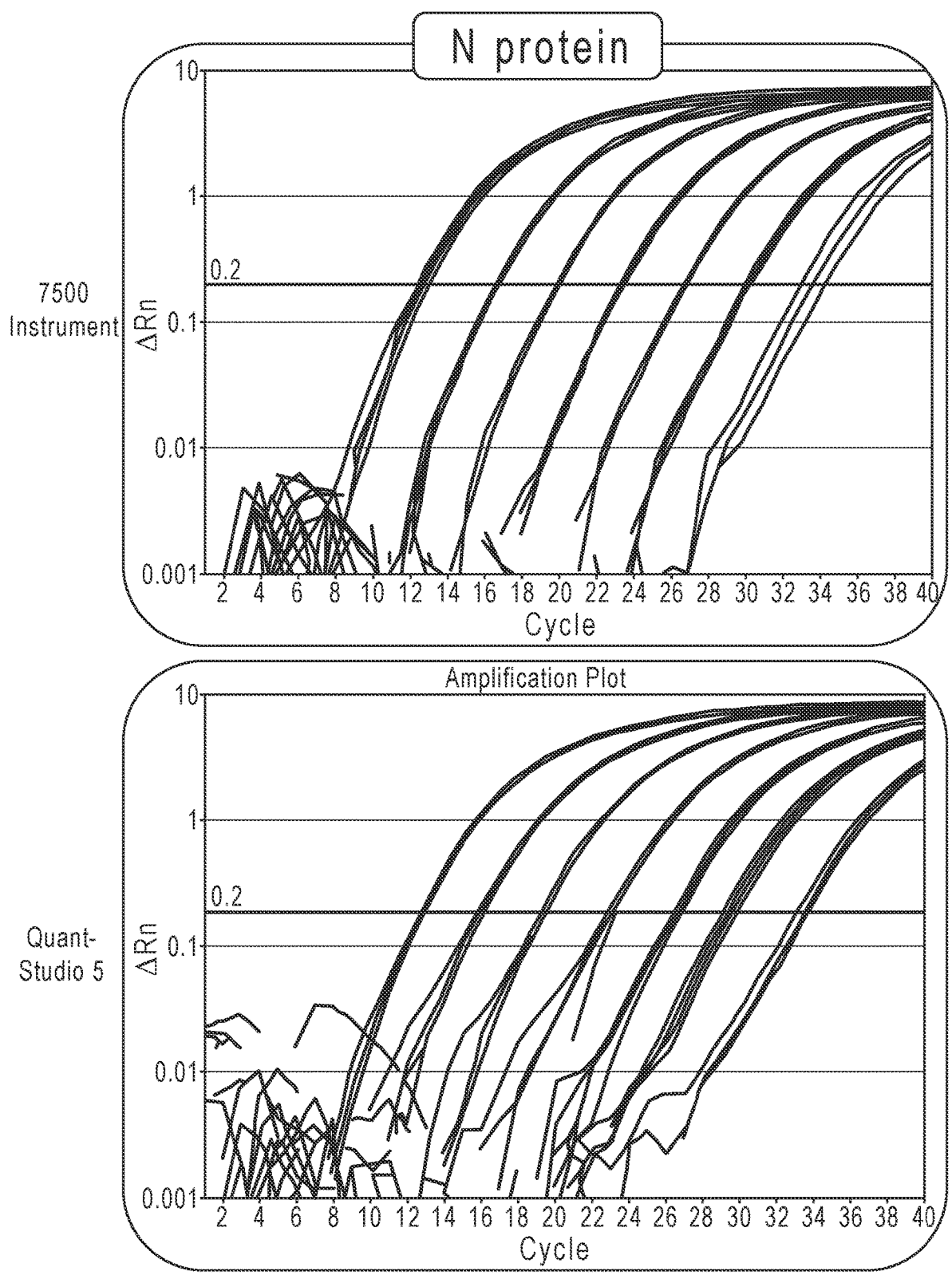
Figure 4C:
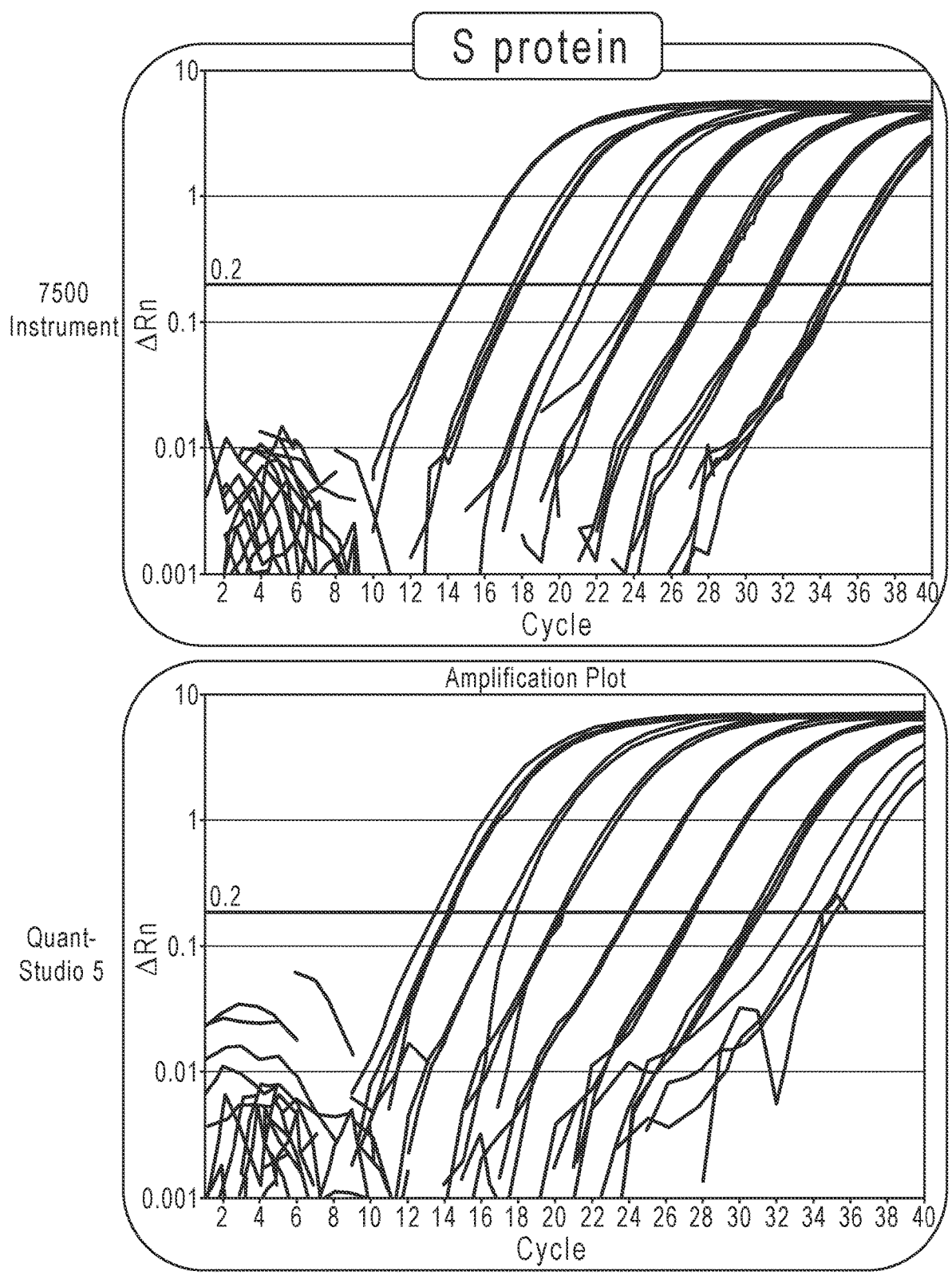

The robustness of assay performance between qPCR instruments was also confirmed. As shown in FIGS. 4A-4C, the disclosed SARS-CoV-2 assays are likely to be effective in identifying SARS-CoV-2 RNA within a sample regardless of whether the 7500 Instrument or the QuantStudio 5 system is used.

Figure 5A:
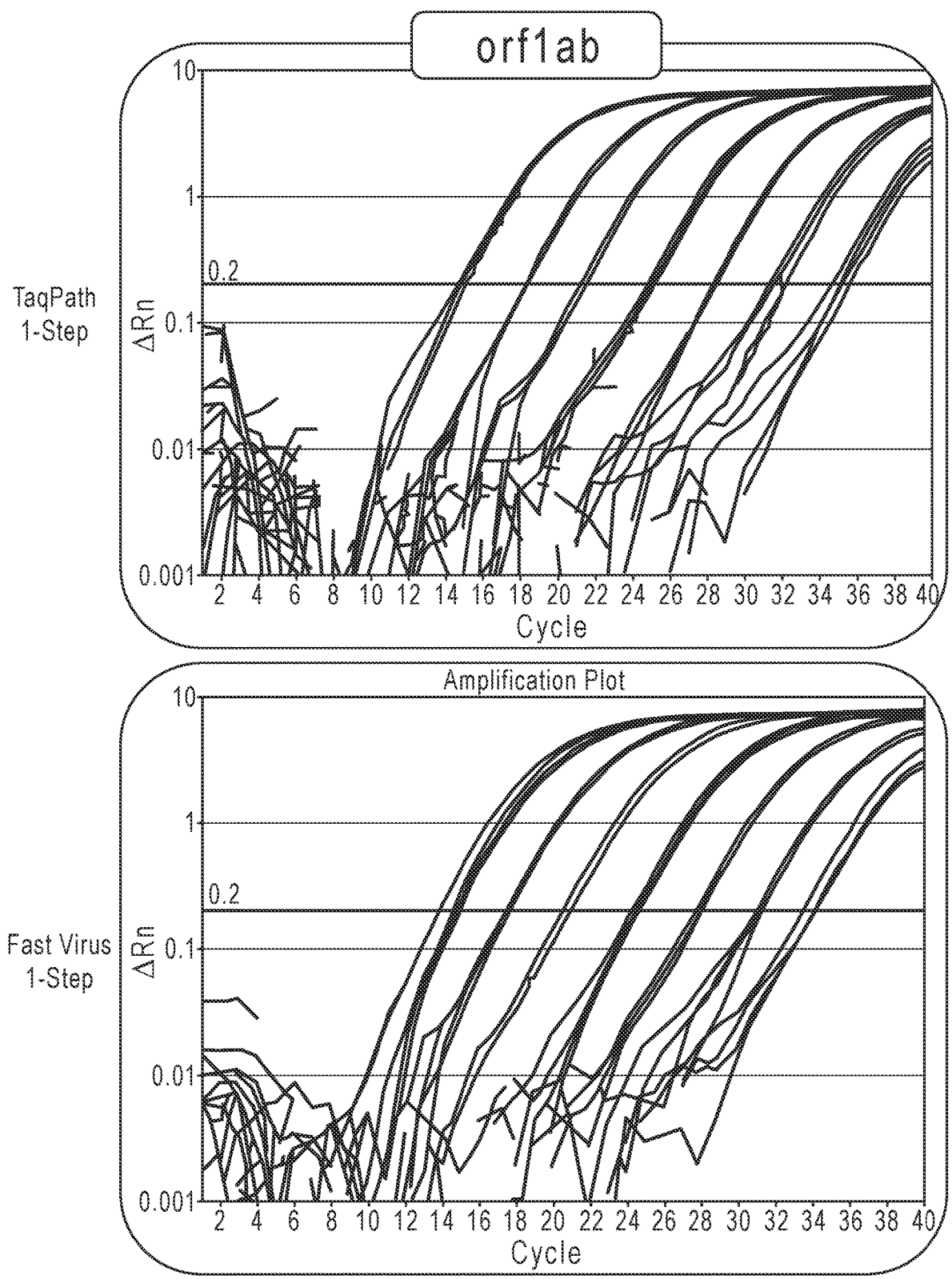
FIGS. 5A-5C illustrate comparative amplification plots of ORF1ab (FIG. 5A), N protein (FIG. 5B), and S protein (FIG. 5C) qPCR assays using the TaqPath 1-Step RT-qPCR Master Mix (Thermo Fisher Scientific) or the TaqMan Fast Virus 1-Step Master Mix (Thermo Fisher Scientific) on the QuantStudio 5 Real-Time PCR System (Thermo Fisher Scientific).
Figure 5B:
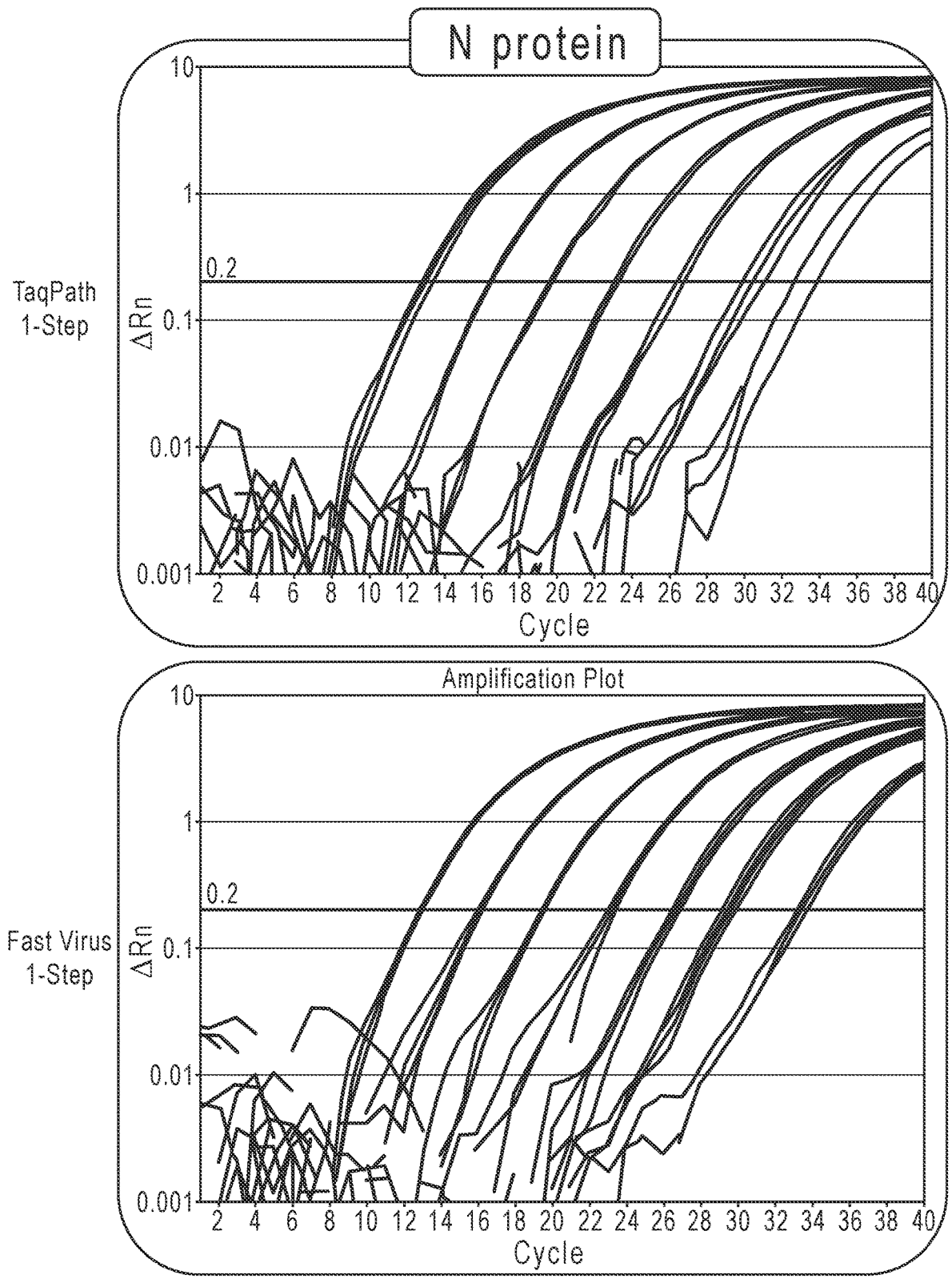
Figure 5C:
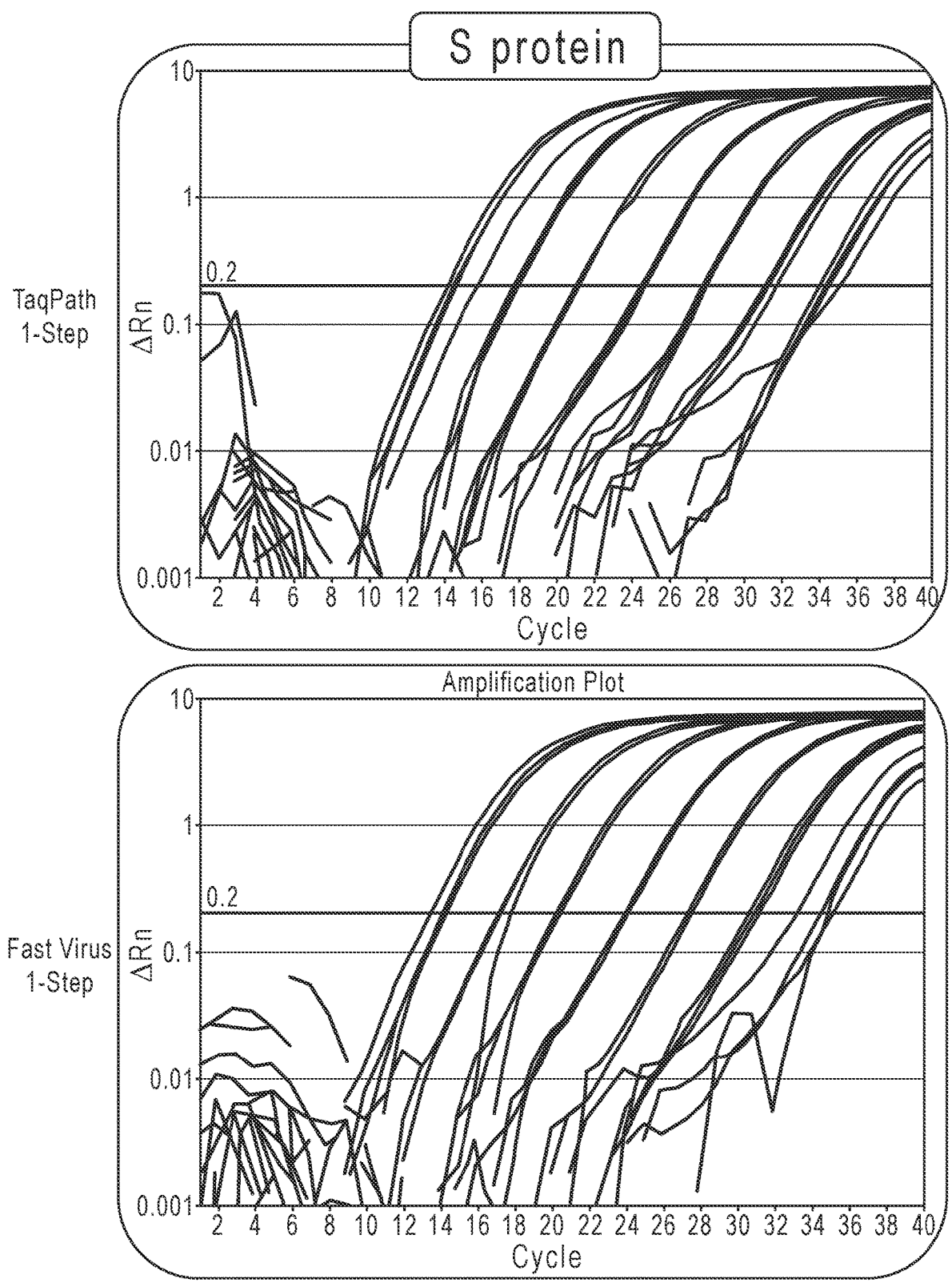

Although assay robustness was not predicted to vary with respect to the type of master mix used, the results shown in FIGS. 4A-4C were specific to assays using TaqMan Fast Virus 1-Step Master Mix. Thus, assay robustness with respect to master mix was also tested. As shown in FIGS. 5A-5C, both the TaqPath 1-Step Master Mix and the Fast Virus 1-Step Master Mix show robust assay performance run on the Quant Studio 5 instrument, making either master mix effective for identifying samples containing SARS-CoV-2 RNA.

A summary of these experiments is shown in Table 13, below, indicating that the disclosed assays are robust enough to identify samples having SARS-CoV-2 RNA regardless of the qPCR master mix, qPCR protocol, or qPCR instrument used.

TABLE 13

Summary of assay robustness survey

| Target | Applied Biosystems Instrument | Applied Biosystems Master Mix | Slope | $R^2$ | Efficiency |
|---|---|---|---|---|---|
| ORF1ab | 7500 Real-Time PCR System | TaqMan Fast Virus 1-Step Master Mix (Standard) | −3.47 | 0.998 | 94.15% |
|  | QuantStudio ™ 5 Real-Time PCR System | TaqMan Fast Virus 1-Step Master Mix (Standard) | −3.321 | 0.998 | 100.02% |
|  |  | TaqPath 1-Step RT-qPCR Master Mix, CG | −3.385 | 0.999 | 97.42% |
| N protein | 7500 Real-Time PCR System | TaqMan Fast Virus 1-Step Master Mix (Standard) | −3.443 | 0.999 | 95.18% |
|  | QuantStudio ™ 5 Real-Time PCR System | TaqMan Fast Virus 1-Step Master Mix (Standard) | −3.417 | 0.999 | 96.18% |
|  |  | TaqPath 1-Step RT-qPCR Master Mix, CG | −3.324 | 0.995 | 99.91% |
| S Protein | 7500 Real-Time PCR System | TaqMan Fast Virus 1-Step Master Mix (Standard) | −3.364 | 0.999 | 98.26% |
|  | QuantStudio ™ 5 Real-Time PCR System | TaqMan Fast Virus 1-Step Master Mix (Standard) | −3.408 | 0.997 | 96.51% |
|  |  | TaqPath 1-Step RT-qPCR Master Mix, CG | −3.319 | 0.998 | 100.11% |

Example 4: Specificity Test of Singleplex and Multiplex Assays for SARS-CoV-2

Nucleic acids of 22 viruses and bacteria (listed below) were extracted with MagMAX Viral/Pathogen Ultra Nucleic Acid Isolation Kit (sold by Thermo Fisher Scientific under Catalog No. A42356) on KingFisher and used for this test. Extracted RNA and DNA were pre-amplified with TaqPath 1-Step RT-qPCR Master Mix, CG and a PreAmp pool containing primers for both SARS-CoV-2 and MEGAPLEX PREAMP PRIMERS,® (sold by Thermo Fisher Scientific Catalog No. A41374). Pre-amplification was carried out using the thermal cycling protocol of described in Table 14 below.

TABLE 14

Pre-amplification protocol

| Step | Stage | # of cycles | Temp. | Time |
|---|---|---|---|---|
| UNG incubation | 1 | 1 | 25° C. | 2 min |
| Reverse transcription† | 2 | 1 | 50° C.† | 30 min |
| Polymerase activation‡ | 3 | 1 | 95° C.‡ | 2 min |
| Amplification | 4 | 14 | 95° C. | 15 sec |
|  |  |  | 60° C. | 2 min |
| Denaturation | 5 | 1 | 99° C. | 10 min |

†Preferably any temperature between 48° C.-55° C.
‡RT inactivation, initial denaturation, and activation of DNAP.

The product of the PreAMP reaction was diluted in a 1:10 ratio with water (preferably RT-PCR grade water), and 5 µL of the diluted PreAmp reaction was added to a 25 µL reaction volume for singleplex and multiplex reactions containing RT-PCR enzymes and assay reagents. The recipe for singleplex reactions is provide in Table 15, and the recipe for multiplex reactions is provided in Table 16.

5 μL of diluted PreAmp reaction (i.e., sample), and 11 μL of water (preferably RT-PCR grade water). Reactions were run on QS5 instrument following recommended protocols of respective master mixes. Three replicates were performed for each sample.

TABLE 15

RT-qPCR Mix for singleplex reactions

| Component | Volume/reaction |
|---|---|
| TaqPath 1-Step Multiplex Master Mix, CG (4X) | 6.25 μL |
| SARS-CoV-2 viral gene singleplex assay (20X) | 1.25 μL |
| RNase P positive control assay (20X) | 1.25 μL |
| Nuclease-free water | 11.25 μL |
| Total Reaction Mix Volume | 20.00 μL |

TABLE 16

RT-qPCR Mix for multiplex reactions

| Component | Volume/reaction |
|---|---|
| TaqPath 1-Step Multiplex Master Mix, (No ROX) | 6.25 μL |
| SARS-CoV-2 viral gene multiplex assay (20X) | 1.25 μL |
| Internal positive control template | 1.00 μL |
| Nuclease-free water | 11.50 μL |
| Total Reaction Mix Volume | 20.00 μL |

The reaction mixes were each vortexed for about 10-30 seconds and centrifuged briefly. The preamplified and diluted samples for each of 22 viruses and bacteria were used for specificity testing. All organisms were obtained from ZeptoMetrix with exception of Coronavirus strain HKU1, which was a clinical isolate. For each reaction mixture and genomic sample to be tested, the components in Table 17, below, were combined within a MicroAmp Optical 96-Well Reaction Plate (0.2 mL/well) in triplicate:

TABLE 17

RT-qPCR Reactions

| Component | Volume/reaction |
|---|---|
| Reaction Mix (see Tables 15 and 16) | 20.00 μL |
| Nucleic acid sample or<br>1 μL 2019-nCoV Control construct + 4 μL PCR-grade water or<br>No template control (5 μL PCR-grade water) | 5.00 μL |
| Total Reaction Volume | 25.00 μL |

Results: None of the 22 organisms tested show cross reactivity to either singleplex or multiplex assays for SARS-CoV-2 detection, as summarized in Table 18 below. Thus, the assays are specific.

TABLE 18

Specificity test results for 2019-nCoV singleplex and multiplex assays

| | Amplification Detected (singleplex assay | multiplex assay) | | | |
|---|---|---|---|---|
| Sample Tested | ORF1ab | N Protein | S Protein | Multiplex control |
| Coronavirus 229E | 0 of 3 | 0 of 3 | 0 of 3 | 0 of 3 | 0 of 3 | 0 of 3 | N/A | 3 of 3 |
| Coronavirus HKU | 0 of 3 | 0 of 3 | 0 of 3 | 0 of 3 | 0 of 3 | 0 of 3 | N/A | 3 of 3 |
| Coronavirus NL63 | 0 of 3 | 0 of 3 | 0 of 3 | 0 of 3 | 0 of 3 | 0 of 3 | N/A | 3 of 3 |
| Coronavirus OC43 | 0 of 3 | 0 of 3 | 0 of 3 | 0 of 3 | 0 of 3 | 0 of 3 | N/A | 3 of 3 |
| Flu A (H3) | 0 of 3 | 0 of 3 | 0 of 3 | 0 of 3 | 0 of 3 | 0 of 3 | N/A | 3 of 3 |
| Flu A (H1-2009) | 0 of 3 | 0 of 3 | 0 of 3 | 0 of 3 | 0 of 3 | 0 of 3 | N/A | 3 of 3 |
| Flu B (Pan) | 0 of 3 | 0 of 3 | 0 of 3 | 0 of 3 | 0 of 3 | 0 of 3 | N/A | 3 of 3 |
| RSV A | 0 of 3 | 0 of 3 | 0 of 3 | 0 of 3 | 0 of 3 | 0 of 3 | N/A | 3 of 3 |
| RSV B | 0 of 3 | 0 of 3 | 0 of 3 | 0 of 3 | 0 of 3 | 0 of 3 | N/A | 3 of 3 |
| Rhinovirus | 0 of 3 | 0 of 3 | 0 of 3 | 0 of 3 | 0 of 3 | 0 of 3 | N/A | 3 of 3 |
| Human parainfluenza virus 1 | 0 of 3 | 0 of 3 | 0 of 3 | 0 of 3 | 0 of 3 | 0 of 3 | N/A | 3 of 3 |
| Human parainfluenza virus 2 | 0 of 3 | 0 of 3 | 0 of 3 | 0 of 3 | 0 of 3 | 0 of 3 | N/A | 3 of 3 |
| Human parainfluenza virus 3 | 0 of 3 | 0 of 3 | 0 of 3 | 0 of 3 | 0 of 3 | 0 of 3 | N/A | 3 of 3 |
| Human parainfluenza virus 4 | 0 of 3 | 0 of 3 | 0 of 3 | 0 of 3 | 0 of 3 | 0 of 3 | N/A | 3 of 3 |
| Enterovirus (Pan) | 0 of 3 | 0 of 3 | 0 of 3 | 0 of 3 | 0 of 3 | 0 of 3 | N/A | 3 of 3 |
| Enterovirus (D68) | 0 of 3 | 0 of 3 | 0 of 3 | 0 of 3 | 0 of 3 | 0 of 3 | N/A | 3 of 3 |
| Human metapneumovirus | 0 of 3 | 0 of 3 | 0 of 3 | 0 of 3 | 0 of 3 | 0 of 3 | N/A | 3 of 3 |
| Adenovirus | 0 of 3 | 0 of 3 | 0 of 3 | 0 of 3 | 0 of 3 | 0 of 3 | N/A | 3 of 3 |
| *Mycoplasma pneumoniae* | 0 of 3 | 0 of 3 | 0 of 3 | 0 of 3 | 0 of 3 | 0 of 3 | N/A | 3 of 3 |
| *Legionella pneomophila* | 0 of 3 | 0 of 3 | 0 of 3 | 0 of 3 | 0 of 3 | 0 of 3 | N/A | 3 of 3 |
| *Bordetella pertussis* | 0 of 3 | 0 of 3 | 0 of 3 | 0 of 3 | 0 of 3 | 0 of 3 | N/A | 3 of 3 |
| *Bordetella parapertussis* | 0 of 3 | 0 of 3 | 0 of 3 | 0 of 3 | 0 of 3 | 0 of 3 | N/A | 3 of 3 |
| No template control | 0 of 3 | 0 of 3 | 0 of 3 | 0 of 3 | 0 of 3 | 0 of 3 | N/A | 3 of 3 |
| 2019nCoV positive control | 0 of 3 | 0 of 3 | 0 of 3 | 0 of 3 | 0 of 3 | 0 of 3 | N/A | 3 of 3 |

Example 5: Mixing RT-PCR Reaction Plates

To ensure proper analysis of SARS-CoV-2 research samples, it is essential to mix the RT-qPCR reaction properly by vortexing the plate. Failure to do so can result in Optical Mixing, a phenomenon that is likely to occur when the sample volume exceeds 20% of the PCR reaction volume. Optical Mixing can lead to RTPCR baseline instability, resulting in QC failure of entire plates and potential false classification of samples.

Mixing Protocol:

After master mix, assay, water, samples, and controls were added to the RT-PCR reaction plate, the plate wells were sealed with a MicroAmp Optical Adhesive Film. The MicroAmp Adhesive Film Applicator was used to make sure all wells were sealed completely. The MicroAmp Optical Adhesive Cover uses a pressure-sensitive adhesive backing to adhere the cover to the optical 96- or 384-well plate. Using enough force to activate the pressure-sensitive adhesive will prevent evaporation from the wells.

The speed of a vortex mixer, such as the Vortex-Genie 2 from Scientific Industries, was set to the highest setting with the activation mode set to "Touch." The vortex mixer was also outfitted with a platform rather than a tube cup.

The plate was contacted with the vortex mixer and held in contact therewith for 10-15 seconds while allowing the vortex platform to move vigorously and cause the reaction mix to move freely in the wells. Too much or too little pressure applied to the vortex platform reduced mixing efficiency. The plate was moved around during vortexing to ensure that contact with the platform has been made at all four quadrants and the center of the plate for equal time.

Experimental Design:

In a first set of experiments, two identical 96-well plates were created. A first plate was vortexed for 30 seconds at maximum speed on a Vortex-Genie 2, and the other plate was not mixed at all. Each plate contained triplicate reactions of extracted contrived positive samples and negative samples. Contrived positive samples consisted of pooled nasopharyngeal specimens spiked with SARS-CoV-2 viral RNA at 9×, 3×, or 1× the Limit of Detection (2,250 GCE/mL, 750 GCE/mL and 250 GCE/mL, respectively). Samples were extracted with either the MagMAX Viral/Pathogen Nucleic Acid Isolation Kit and a 400-μL specimen volume or the MagMAX Viral/Pathogen II Nucleic Acid Isolation Kit and a 200-μL specimen volume, and both extraction workflows were run on the same RT-PCR plate.

In a second set of experiments, two identical 384-well plates were created; one plate was vortexed for 10 seconds at maximum speed on a Vortex-Genie 2, and the other plate was not mixed at all. Each plate contained 48 replicate reactions of extracted SARS-CoV-2 viral RNA at 10 GCE/reaction plus the MS2 Internal Control. RT-PCR runs were performed on an Applied Biosystems QuantStudio 7 Flex system with a 384-well block.

Results:

The 96-well and 384-well plates that were not mixed demonstrated steep downward slopes in the fluorescent signal during the early cycles of the thermal protocol. By contrast, the 96-well and 384-well plates that were mixed revealed that proper mixing produces flatter baselines for the same conditions. Thus, compared with no mixing, vortexing for 10-30 seconds produces flatter baselines irrespective of extraction protocol, plate type, or sample type. Because falling baselines can produce plate failures or inaccurate results, vortex mixing appears important for achieving reliable, specific results.

Example 6: SARS-CoV-2, Flu A/B, RSV Multiplex Assay

An exemplary protocol for detecting the presence of genomic nucleic acid associated with SARS-CoV-2, Flu A/B, or RSV from a biological sample via a multiplex assay was performed using primers and FAM-labeled probe for detecting target sequences from Flu (Influenza) Types A and B genomes (SEQ ID NOs: 252, 253, 257, 505, 506, 1296 and 1297); primers and VIC-labeled probe for detecting SARS-CoV-2 target sequences from the S gene in SARS-CoV-2 (SEQ ID NOs: 100, 337 and 864), and N protein (SEQ ID NOs: 211, 510 and 833), primers and ABY-labeled probes for detecting target sequences specific for the RSV viral genome (SEQ ID Nos: 254, 255, 507, 508, 1298 and 1299), and primers and JUN-labeled probes for an internal positive control directed to an exogenous MS2 RNA template (SEQ ID NOS: 206, 509 and 1300). The primer of SEQ ID NO: 510 used for this experiment is similar to the primer of SEQ ID NO: 501, but also includes an additional "A" nucleotide residue at the 3' end. The addition of this residue was found to be helpful in reducing artifacts formed during PCR reactions containing certain additional primers and probes.

In separate wells, the same primers/probes were included and used together with a synthetic positive control construct encoding the target sequences for identifying SARS-CoV-2, Flu (A and B), and RSV.

The total nucleic acid content was isolated from samples collected via nasopharyngeal swab, nasopharyngeal aspirate, or bronchoalveolar lavage using the MagMAX Viral/Pathogen Nucleic Acid Isolation Kit (sold by Thermo Fisher Scientific under Cat. No. A42356) in accordance with the instructions provided therewith.

The components in one of Tables 19A-19C were combined to make the RT-PCR Reaction Mix for the total number of reactions, plus 10% overage:

TABLE 19A

| RT-qPCR Reaction Mix | |
| --- | --- |
| Component | Volume/reaction |
| TaqPath 1-Step Multiplex Master Mix, CG (4X) | 6.25 μL |
| Primers and probes | 1.25 μL |
| Total Reaction Mix Volume | 7.50 μL |

TABLE 19B

| RT-qPCR Reaction Mix | |
| --- | --- |
| Component | Volume/reaction |
| TaqPath 1-Step Multiplex Master Mix, CG (4X) | 6.25 μL |
| Primers and probes | 1.25 μL |
| Nuclease-free Water | 7.5 μL |
| Total Reaction Mix Volume | 15.0 μL |

TABLE 19C

RT-qPCR Reaction Mix (400-µL sample input volume)

| Component | Volume/reaction |
|---|---|
| TaqPath 1-Step Multiplex Master Mix, CG (4X) | 6.25 µL |
| Primers and probes | 1.25 µL |
| Nuclease-free Water | 12.50 µL |
| Total Reaction Mix Volume | 20.0 µL |

The reaction mixes were vortexed for about 10-30 seconds) and centrifuged briefly. For each reaction, the components in Table 20A-20D, below, were combined in a MicroAmp Optical 96-Well Reaction Plate:

TABLE 20A

RT-qPCR Reactions (0.2 mL/well)

| | Volume/reaction | | |
|---|---|---|---|
| Component | RNA Sample | Pos. Control | Neg. Control |
| Reaction Mix (see Table 19A) | 7.5 µL | 7.5 µL | 7.5 µL |
| Purified sample RNA | 17.5 µL | — | — |
| Diluted TaqMan SARS-CoV-2, Flu A/B, RSV RNA Control | — | 17.5 µL | — |
| Negative Control (from RNA extraction) | — | — | 17.5 µL |
| Total Reaction Volume | 25.0 µL | 25.0 µL | 25.0 µL |

TABLE 20B

RT-qPCR Reactions (0.2 mL/well)

| | Volume/reaction | | |
|---|---|---|---|
| Component | RNA Sample | Pos. Control | Neg. Control |
| Reaction Mix (see Table 19A) | 7.5 µL | 7.5 µL | 7.5 µL |
| Purified sample RNA | 17.5 µL | — | — |
| Diluted TaqMan SARS-CoV-2, Flu A/B, RSV RNA Control | — | 2.0 µL | — |
| Nuclease-free Water | — | 15.5 µL | — |
| Negative Control (from RNA extraction) | — | — | 17.5 µL |
| Total Reaction Volume | 25.0 µL | 25.0 µL | 25.0 µL |

TABLE 20C

RT-qPCR Reactions (0.2 mL/well)

| | Volume/reaction | | |
|---|---|---|---|
| Component | RNA Sample | Pos. Control | Neg. Control |
| Reaction Mix (see Table 19B) | 15.0 µL | 15.0 µL | 15.0 µL |
| Purified sample RNA | 10.0 µL | — | — |
| Diluted TaqMan SARS-CoV-2, Flu A/B, RSV RNA Control | — | 2.0 µL | — |
| Nuclease-free Water | — | 8 µL | — |
| Negative Control (from RNA extraction) | — | — | 10.0 µL |
| Total Reaction Volume | 25.0 µL | 25.0 µL | 25.0 µL |

TABLE 20D

RT-qPCR Reactions (0.4 mL/well)

| | Volume/reaction | | |
|---|---|---|---|
| Component | RNA Sample | Pos. Control | Neg. Control |
| Reaction Mix (see Table 19C) | 20.0 µL | 20.0 µL | 20.0 µL |
| Purified sample RNA | 5 µL | — | — |
| Diluted TaqMan SARS-CoV-2, Flu A/B, RSV RNA Control | — | 2.0 µL | — |
| Nuclease-free Water | — | 3.0 µL | — |
| Negative Control (from RNA extraction) | — | — | 5.0 µL |
| Total Reaction Volume | 25.0 µL | 25.0 µL | 25.0 µL |

The plate was sealed with a MicroAmp Optical Adhesive Film and vortexed briefly to mix the contents. The plate was centrifuged briefly to collect the contents at the bottom of the wells. The plate was loaded into a 7500 Real-Time PCR Instrument and the protocol in Table 21 was run.

TABLE 21

RT-qPCR Protocol for Multi-Pathogen Multiplex Assay

| Step | Stage | # of cycles | Temp. | Time |
|---|---|---|---|---|
| UNG incubation | 1 | 1 | 25° C. | 2 min |
| Reverse transcription[†] | 2 | 1 | 53° C.[†] | 10 min |
| Preincubation | 3 | 1 | 85° C. | 10 min |
| Polymerase activation | 4 | 1 | 95° C.[‡] | 2 min |
| Amplification | 5 | 46 | 95° C. | 3 sec |
| | | | 60° C. | 30 sec |

[†]Preferably any temperature between 48° C.-55° C.

The results for each tested sample having amplified product in the positive control and no amplified product in the negative control were interpreted to have: (i) SARS-CoV-2 RNA present if the VIC signal was positive, (ii) Flu AB if the FAM signal was positive, and/or (iii) RSV if the ABY signal was positive.

Example 7

A 4-plex RT-qPCR assay was developed in 1-tube, for nucleic acid detection of SARS-CoV-2, Flu A, and Flu B viruses along with a process control. This SARS-CoV-2 portion of the 4-plex assay targets both S protein and N protein regions having higher specificity and exhibiting lower risk for mutation. The primers targeting the S protein region were SEQ ID NOs: 100 and 337, with the associated probe of SEQ ID NO: 864. The primers targeting the N protein region were SEQ ID NOs: 211 and 510, with the associated probe of SEQ ID NO: 833. A proprietary bioinformatics pipeline was used to design specific assays for Flu A and Flu B with great coverage. The resulting strain coverage for the primer and probe sets was 99.9% for SARS-CoV-2 with 35,833 high quality complete sequences. The resulting strain coverage for the primer and probe sets for Flu A and Flu B is 6,730/6,854 or 98.2%, and 3,105/3,127 or 99.3%, respectively. Assays were tested with qPCR instruments such as QS5 and 7500 Fast Dx using a modified RT-PCR protocol based on TaqPath COVID-19 Combo Kit (Appendix 2) and using the same master mix, water and dNTPs provided therein.

DNA, in vitro transcribed RNA, genomic RNA, and viral organism controls are used at different stages of feasibility testing and development. DNA and in vitro transcribed RNA controls include SARS-CoV-2, Flu A and Flu B. Viral RNA and viral organism controls include SARS-CoV-2, genomic RNA, and gamma irradiation inactivated virus Influenza A: H1N1 (Brisbane/59/2007) and H3N2 (Perth/16/2009), and Influenza B: Victoria lineage (Wisconsin/01/2010) and Yamagata lineage (Florida/04/2006).

PCR thermal cycling protocol was done according to our previous TaqPath COVID-19 Combo Kit with two modifications: (1) a preincubation step (85° C., 10 min) was added after RT (preincubation reduces ABY channel's abnormal amplification curves); and (2) the number of cycles was increased from 40 to 46 (increases ΔRn of true amplification above maximum crosstalk level).

Criteria for the analytical validation studies:

The workflow limit of detection (LoD) will be established as the lowest concentration of GCE of the virus that can be detected ≥95% of the time (e.g., ≥19/20 replicates).

Reactivity/inclusivity: 100% of strains tested must by detected by the assay; Strains not detected at 3×LoD will be retested at higher concentrations until 100% hit rate is achieved; 100% of replicates must be positive.

Interference substance: A substance will be determined to be non-interfering at the tested concentration if 100% of replicates produce the expected results for a given interferent.

Competitive interference: At least 95% of positive samples at 4×LoD or lower produce a result of Positive in the presence of competitors at 1,000×LoD or higher $\Delta C_t$=Mean Combination $C_t$–Mean Single Target $C_t \leq 1.5$ Cycles The 4-plex real-time PCR assays can simultaneously detect and differentiate SARS-CoV-2, Flu A, and Flu B viral nucleic acids. In the tested examples, Flu A primers and probe sets were associated with the FAM channel, SARS-CoV-2 N protein and S protein primers and probe sets were associated with the VIC channel, Flu B primers and probe sets were associated with the ABY channel, and the internal control MS2 primers and probe sets were associated with the JUN channel.

One strain of SARS-CoV-2, two strains of Flu A (one H1N1 and one H3N2) and two strains of Flu B (one Victoria lineage and one Yamagata lineage) were examined for workflow LoD. Viral RNA extraction using MagMAX Viral/Pathogen II (MVP II) Nucleic Acid Isolation Kit and KingFisher Flex 96 Deep Well. RT-qPCR was performed on the 7500 Fast Dx Real-Time PCR system and the QuantStudio 5 Real-Time PCR Instrument. The results from the workflow limits of detection are provided in Table 22 below.

TABLE 22

Workflow Limits of Detection (LoD)

| Virus | Subtype | Strain | Limit of Detection | |
|---|---|---|---|---|
| SARS-CoV-2 | N/A | USA-WA1/2020 | 100 GCE/mL | 0.16 TCID$_{50}$/mL |
| Flu A (Perth) | H3N2 | A/Perth/16/2009 | 200 GCE/mL | 0.00249 TCID$_{50}$/mL |
| Flu A (Brisbane) | H1N1 | A/Brisbane/59/2007 | 500 GCE/mL | 0.00159 TCID$_{50}$/mL |
| Flu B (Florida) | Yamagata | B/Florida/04/2006 | 500 GCE/mL | 0.0588 TCID$_{50}$/mL |
| Flu B (Wisconsin) | Victoria | B/Wisconsin/01/2010 | 1000 GCE/mL | 0.00560 TCID$_{50}$/mL |

The primers and probes used in the 4-plex assay did not cross-react with any of the 41 respiratory pathogens tested and listed in Table 23 below.

TABLE 23

RT-qPCR Protocol for Multi-Pathogen Multiplex Assay

| Bacteria and Fungi | Viruses | Purified DNA |
|---|---|---|
| Chlamydia pneumoniae | Adenovirus | Bacillus anthracis |
| Bordetella pertussis | Enterovirus | Leptospira interrogans |
| Candida albicans | Coronavirus 229E | Moraxella catarrhalis |
| Corynebacterium diphtheriae | Coronavirus NL63 | Mycobacterium tuberculosis |
| Haemophilus influenzae | Coronavirus OC43 | Streptococcus pneumoniae |
| Legionella non- pneumophila | Human Metapneumovirus | Streptococcus pyogenes |
| Legionella pneumophila | Influenza C virus | Coronavirus HKU1 |
| Neisseria elongata | MERS-CoV | Chlamydia psittaci |
| Neisseria meningitidis | Parainfluenza virus 1 | Coxiella burnetii |
| Pseudomonas aeruginosa | Parainfluenza virus 2 | |
| Staphylococcus aureus | Parainfluenza virus 3 | |
| Staphylococcus epidermidis | Parainfluenza virus 4 | |
| Streptococcus salivarius | Parechovirus | |
| Pneumocystis carinni | RSV A | |
| Mycoplasma pneumoniae | RSV B | |
| | Rhinovirus | |
| | SARS-CoV | |

Possible interference substances were tested to demonstrate the ability of this 4-plex test to detect each target virus at a low concentration in the presence of potentially interfering substances and to demonstrate that the potential interferents alone do not produce false positive results. Blood, corticosteroid nasal spray, nasal gel, homeopathic allergy relief nasal spray, throat lozenges, Oseltamivir, antibiotic ointment, and systemic antibiotics tested show no interference. Afrin Original nasal spray showed interference at 10% v/v, so it was titrated down to find the concentration at which no inhibition was observed. The maximum, non-inhibitory concentration was 0.6% on both instruments and all viruses tested. The results are summarized in Table 24 below.

TABLE 24

RT-qPCR Protocol for Multi-Pathogen Multiplex Assay

| Potential Interfering Substance | Final Concentration | Result |
| --- | --- | --- |
| Mucin | 0.1 mg/mL | Pass |
| Blood | 1% v/v | Pass |
| Nasal spray | 10% v/v | Pass |
| Nasal corticosteroid | 5 µg/mL | Pass |
| Nasal gel | 1% w/v | Pass |
| Homeopathic allergy relief medicine | 10% v/v | Pass |
| Throat lozenges | 1% w/v | Pass |
| Oseltamivir phosphate | 33 µg/mL | Pass |
| Antibiotic, nasal ointment | 5 µg/mL | Pass |
| Systemic Antibiotic | 0.6 mg/mL | Pass |

A competitive interference study was also performed to assess the ability of the 4-plex SARS-CoV-2, Flu A, and Flu B test to detect each target virus at a low concentration in the presence of another target virus at a high concentration. Competitive interference testing was performed using contrived NP samples with SARS-CoV-2, Flu A, and Flu B with one virus at a concentration less than or equal to three times its LoD and the other tested virus at a concentration greater than or equal to $10^5$ TCID$_{50}$/mL. A summary of the results is in Table 25 below.

TABLE 25

Competitive Interference Results

| Virus combination | Concentration Passed |
| --- | --- |
| SARS-CoV-2$^{lo}$ FluB$^{hi}$ | 3X LoD |
| FluB$^{lo}$ SARS-CoV-2$^{hi}$ | 3X LoD |
| FluA$^{lo}$ FluB$^{hi}$ | 3X LoD |
| FluB$^{lo}$ FluA$^{hi}$ | 3X LoD |
| SARS-CoV-2$^{lo}$ FluA$^{lo}$ FluB$^{lo}$ | 3X LoD |
| SARS-CoV-2$^{lo}$ FluA$^{hi}$ | 4X LoD |
| FluA$^{lo}$ SARS-CoV-2$^{hi}$ | 4X LoD |

Example 8: Limit of Detection

The purpose of this study was to establish the Limits of Detection (LoD) for SARS-CoV-2, influenza A, influenza B, RSV A, and RSV B for use on a 96-well real-time PCR platform. The experiment uses primers targeting the S protein and N protein of SARS-CoV-2. The primers targeting the S protein region were SEQ ID NOs: 100 and 337, with the associated probe of SEQ ID NO: 864. The primers targeting the N protein region were SEQ ID NOs: 211 and 510, with the associated probe of SEQ ID NO: 833. The LoD will be established as the lowest number (concentration) of Genomic Copy Equivalents (GCE) of each virus that can be detected at least 95% of the time.

Individual LoD for each of the viruses detected by the COVID/Flu/RSV test were determined using contrived specimens comprising inactivated SARS-CoV-2 virus and live influenza A and B, and respiratory syncytial viruses spiked at various levels into pooled nasopharyngeal (NP) swab specimens. Inactivated SARS-CoV-2 virus was obtained from BEI Resources (PN NR-52287, LN 70033322). Two strains of live influenza A virus (referred to as Perth and Brisbane, respectively) were obtained from ZeptoMetrix: Influenza A H3N2 (strain A/Perth/16/2009; PN 0810251CF, LN 313219) and Influenza A H1N1 (strain A/Brisbane/59/2007; PN 0810244CF, LN 323919). Two strains of live influenza B virus (referred to as Florida and Wisconsin, respectively) were obtained from ZeptoMetrix: Influenza B Yamagata lineage (strain B/Florida/04/2006; PN 0810255CF, LN 312479) and Influenza B Victoria lineage (strain B/Wisconsin/01/2010; PN 0810241CF, LN 324993). One strain of RSV A virus was obtained from ZeptoMetrix (PN 0810040ACF, LN 324695). One strain of RSV B virus was obtained from ZeptoMetrix (PN 0810480CF, LN 322742). The quantitated GCE/mL values for the stock materials were determined by dPCR, and dilutions were appropriately formulated based on this information.

Sample extraction was performed using the MagMAX Viral/Pathogen II Nucleic Acid Isolation Kit and KingFisher Flex system. Samples were tested using the COVID/Flu/RSV test with the TaqPath 1-Step Multiplex Master Mix (No ROX) on the Applied Biosystem 7500 Fast Real-Time PCR Instrument. The study was conducted in three phases: a preliminary LoD was determined in Phase I of the study, a refined LoD was determined in Phase II, and the LoD was confirmed in Phase III. A preliminary LoD was determined in Phase I by testing contrived samples with known GCEs at six levels, beginning from sample extraction. Preliminary LoD testing was performed with three replicate contrived samples at each GCE level. Following determination of the preliminary LoD, Phase II refined the LoD with five replicate specimens per five levels at, below, and above, the preliminary LoD, and Phase III confirmed the LoD with at least 95% detection across 20 replicate samples.

Testing was performed under manufacturer-recommended conditions for the KingFisher Flex and Real-Time PCR instruments. Room temperature steps were performed in laboratories with a temperature between 15° C. and 30° C.

All remaining non-oligonucleotide reagents (e.g., master mix, water, dNTPs, etc.) were obtain from the TaqPath™ COVID-19 Combo kit (Thermo Fisher Scientific, Catalog No. A47814) and RT-PCR was conducted according to the protocol supplied therewith.

Procedure

A pool of at least 175 mL of NP specimens was prepared and divided equally for the five viruses; the same pool of each virus was used for the entire study phase.

Inactivated SARS-CoV-2 virus was obtained and diluted in Nucleic Acid Dilution Solution (NADS) or VTM just prior to extraction in accordance with Table 26; each dilution was mixed gently but thoroughly. To prevent cross-contamination, gloves were changed after making the intermediate dilutions and before beginning the LoD dilutions. Calculations in the following table were based on a stock concentration of $1.75 \times 10^9$ GCE/mL ($2.8 \times 10^9$ TCID$_{50}$/mL); if inactivated SARS-CoV-2 virus was not formulated at this concentration, the calculations were amended to produce the following concentrations.

TABLE 26

| Dilution ID | Final Conc. Virus | Vol. Virus Stock | Vol. Diluent | Vol. NP Pool |
| --- | --- | --- | --- | --- |
| Intermed-1 | $5.0 \times 10^7$ GCE/mL | 2.0 μL of stock | 68.0 μL | — |
| Intermed-2 | $5.0 \times 10^5$ GCE/mL | 10 μL of Intermed-1 | 990 μL | — |
| Intermed-3 | $5.0 \times 10^3$ GCE/mL | 20 μL of Intermed-2 | 1980 μL | — |
| 1 | $2.5 \times 10^3$ GCE/mL | 1500 μL of Intermed-3 | — | 1500 μL |
| 2 | $1.25 \times 10^3$ GCE/mL | 1500 μL of Dilution 1 | — | 1500 μL |
| 3 | $5.0 \times 10^2$ GCE/mL | 1200 μL of Dilution 2 | — | 1800 μL |
| 4 | $2.5 \times 10^2$ GCE/mL | 1500 μL of Dilution 3 | — | 1500 μL |
| 5 | 100 GCE/mL | 1200 μL of Dilution 4 | — | 1800 μL |
| 6 | 50 GCE/mL | 1500 μL of Dilution 5 | — | 1500 μL |
| 7 | 0 GCE/mL | — | — | 1500 μL |

Live RSV A, RSV B, Flu A and Flu B viruses were obtained and viral genomic RNA was quantitated by digital PCR. Live RSV A, RSV B, Flu A virus, and Flu B virus were diluted to the same concentrations based upon the concentrations determined by digital PCR. Either NADS or VTM were used as the virus diluent.

LoD Phase I

Each test level included at least three replicate extractions. The preliminary LoD was the lowest concentration at which all three extraction replicates produce a result of Positive.

Using the specimens prepared in steps 12.2 and 12.3, Contrived samples were extracted in triplicate from the specimens prepared and were tested by RT-qPCR on a 7500 Fast platform. The preliminary LoD was calculated as the lowest concentration (highest Test Level ID) at which all three extraction replicates produced a result of Positive.

On the 7500 Fast real-time PCR instrument, the Preliminary LoD for SARS-CoV-2 was established in Phase I as 50 GCE/mL, the Preliminary LoD for Flu A (Perth) was established in Phase I as 250 GCE/mL, the Preliminary LoD for Flu A (Brisbane) was established in Phase I as 384 GCE/mL, the Preliminary LoD for Flu B (Florida) was established in Phase I as 500 GCE/mL, the Preliminary LoD for Flu B (Wisconsin) was established in Phase I as 250 GCE/mL, the Preliminary LoD for RSV A was established in Phase I as 50 GCE/mL, and the Preliminary LoD for RSV B was established in Phase I as 250 GCE/mL.

LoD Phase II

Each test level included at least five replicate extractions. The refined LoD was the lowest concentration at which all five extraction replicates produced a result of Positive.

Contrived samples were prepared to the levels in Table 27 below with at least five replicates per Test Level. Virus dilutions compatible with the concentrations being tested were formulated, and contrived samples were extracted and tested by RT-qPCR on a 7500 Fast platform. The refined LoD was calculated for each virus as the lowest concentration (highest Test Level ID) at which all five extraction replicates produced a result of Positive.

TABLE 27

| Test Level ID | Final Concentration Virus | Replicates |
| --- | --- | --- |
| 1 | 3X Preliminary LoD | 5 |
| 2 | 2X Preliminary LoD | 5 |
| 3 | Preliminary LoD | 5 |
| 4 | 0.5X Preliminary LoD | 5 |
| 5 | 0.33X Preliminary LoD | 5 |
| 6 | 0 GCE | 5 |

On the 7500 Fast real-time PCR instrument, the Refined LoD for SARS-CoV-2 was established in Phase II as 50 GCE/mL, the Refined LoD for Flu A (Perth) was established in Phase II as 250 GCE/mL, the Refined LoD for Flu A (Brisbane) was established in Phase II as 768 GCE/mL, the Refined LoD for Flu B (Florida) was established in Phase II as 1000 GCE/mL, the Refined LoD for Flu B (Wisconsin) was established in Phase II as 250 GCE/mL, the Refined LoD for RSV A was established in Phase II as 150 GCE/mL, and the Refined LoD for RSV B was established in Phase II as 200 GCE/mL.

LoD Phase III

The refined LoD determined in Phase II was confirmed with at least 20 replicate extractions. The LoD was confirmed if at least 19 of 20 extraction replicates produced a result of Positive.

Contrived samples were prepared to the levels in Table 28 below with at least twenty replicates per Test Level. Virus dilutions compatible with the concentrations being tested were formulated, and contrived samples were extracted and tested by RT-qPCR on a 7500 Fast platform. The LoD for each specimen was confirmed if at least 95% of extraction replicates produced a result of Positive. If the LoD was not confirmed for any of the five viruses, Phase III was repeated for that virus at a higher concentration.

TABLE 28

| Test Level ID | Final Concentration Virus | Replicates |
| --- | --- | --- |
| 1 | Refined LoD | 20 |
| 2 | 0 GCE | 1 |

On the 7500 Fast real-time PCR instrument, the Confirmed LoD for SARS-CoV-2 established in Phase III was 50 GCE/mL, the Confirmed LoD for Flu A (Perth) established in Phase III was 350 GCE/mL, the Confirmed LoD for Flu A (Brisbane) established in Phase III was 384 GCE/mL, the Confirmed LoD for Flu B (Florida) established in Phase III was 1250 GCE/mL, the Confirmed LoD for Flu B (Wisconsin) established in Phase III was 350 GCE/mL, the Confirmed LoD for RSV A established in Phase III was 200 GCE/mL, and the Confirmed LoD for RSV B established in Phase III was 200 GCE/mL.

LoDs for the TaqPath COVID-19, Flu A/Flu B, RSV Combo Kit (COVID/Flu/RSV test) were established using the 7500 Fast real-time PCR instrument (e.g., 7500 Fast Dx for 96-well plates using 17.5 μL of reaction volume input and QS7 Flex for 384-well plates using 14 μL of reaction volume input); the results are summarized in Table 29 below.

TABLE 29

Summary Workflow Limits of Detection (LoD)

| Virus | Subtype | Strain | Limit of Detection | |
|---|---|---|---|---|
| SARS-CoV-2 | N/A | USA-WA1/2020 | 50 GCE/mL | 0.00824 TCID$_{50}$/mL |
| Flu A (Perth) | H3N2 | A/Perth/16/2009 | 350 GCE/mL | 0.0221 TCID$_{50}$/mL |
| Flu A (Brisbane) | H1N1 | A/Brisbane/59/2007 | 384 GCE/mL | 0.00123 TCID$_{50}$/mL |
| Flu B (Florida) | Yamagata | B/Florida/04/2006 | 1250 GCE/mL | 0.147 TCID$_{50}$/mL |
| Flu B (Wisconsin) | Victoria | B/Wisconsin/01/2010 | 350 GCE/mL | 0.00424 TCID$_{50}$/mL |
| RSV A | N/A | A/2006 | 200 GCE/mL | 0.0136 TCID$_{50}$/mL |
| RSV B | N/A | B/3/2015 Isolate #2 | 200 GCE/mL | 0.0131 TCID$_{50}$/mL |

Example 9: SARS-CoV-2 Fast PCR Assay

Raw saliva samples were heated in a 95° C. water bath for 30 minutes and subsequently allowed to equilibrate to room temperature. Each heat-treated sample was vortexed at maximum speed for 10 seconds or until the sample appeared homogenous. 100 μL of each heated treated saliva sample was transferred to individual wells of a 96-well plate having 100 μL of a TBE-T mix prepared therein. The TBE-T mix included 50 μL TBE buffer and 50 μL Tween-20 detergent. Each well was mixed by pipetting gently. Any storage prior to RT-PCR was done at 4° C. or on ice for up to 2 hours.

The components in Table 30 were combined to make the RT-PCR Reaction Mix for the total number of reactions, plus 10% overage (with the Multiplex Reagents and Control reagents obtained from Thermo Fisher Catalog Nos. A47701 and 956125, respectively.

TABLE 30

RT-qPCR Reaction Mix

| Component | Volume/reaction |
|---|---|
| TaqPath 1-Step Multiplex Master Mix, CG (4X) | 2.5 μL |
| TaqMan SARS-CoV-2, Flu A, Flu B Multiplex Reagents | 0.5 μL |
| Nuclease-free water | 2.0 μL |
| Total Reaction Mix Volume | 5.0 μL |

The reaction mixes were vortexed for about 10-30 seconds) and centrifuged briefly. For each reaction, the components in Table 31, below, were combined in a MicroAmp Optical 384-Well Reaction Plate (0.2 mL/well):

TABLE 31

RT-qPCR Reactions

| | Volume/reaction | | |
|---|---|---|---|
| Component | RNA Sample | Pos. Control | Neg. Control |
| Reaction Mix (see Table 30) | 5.0 μL | 5.0 μL | 5.0 μL |
| Prepared sample (saliva + TBE-T) | 5.0 μL | — | — |
| Diluted TaqMan SARS-CoV-2, Flu A, Flu B, RNA Control | — | 17.5 μL | — |
| Nuclease-free water | — | — | 5.0 μL |
| Total Reaction Volume | 10.00 μL | 10.0 μL | 10.0 μL |

The plate was sealed with a MicroAmp Optical Adhesive Film and vortexed briefly to mix the contents. The plate was centrifuged briefly to collect the contents at the bottom of the wells. The plate was loaded into a 7500 Real-Time PCR Instrument and the protocol in Table 32 was run.

TABLE 32

RT-qPCR Protocol for Multi-Pathogen Multiplex Assay

| Step | Stage | # of cycles | Temp. | Time |
|---|---|---|---|---|
| Reverse transcription | 1 | 1 | 50° C. | 4 min |
| Polymerase activation | 2 | 1 | 95° C. | 2 min |
| Amplification | 3 | 40 | 95° C. | 1 sec |
| | | | 60° C. | 20 sec |

Appropriate analysis parameters were identified using the baseline threshold algorithm with manual threshold settings on Applied Biosystems qPCR instruments to calculate Ct values. With this algorithm, there were two primary analysis settings impacting Ct value—baseline and threshold. The baseline is set individually for each amplification curve and defines the region of baseline significant fluorescence signal detected, which can help normalize well-to-well variance in background noise during early cycles. Automatic baselining using a start cycle of 5 was initially used for the TaqCheck SARS-CoV-2 Fast PCR Assay.

Once the primary analysis settings were established, Ct cutoffs were defined for each target for both samples and controls. Cutoffs were evaluated using data generated with no template controls and other negative controls to exclude spurious amplification such as contamination introduced from the environment. Cutoffs were also assessed in context of data assessing the dynamic range of the assay. For example, an acceptable Ct cutoff excludes background contamination in the NTC while capturing true amplification within the verified dynamic range.

The first experiment determined the maximum level of background fluorescence signal and therefore the lowest that ΔRn thresholds could be set. This experiment consisted of running single-amplification wells from SARS-CoV-2 in vitro transcribed RNA ($1 \times 10^7$ copies/well) and human universal human reference RNA (1 mg) in 4 corner wells and 4 wells in the center of a 384-well plate on 8 different QuantStudio 5 instruments.

The second experiment assessed variability of RNAse P Ct values and the real-world effects of inhibition on the overall strength of qPCR amplification and therefore how high ΔRn thresholds could be set. This experiment was accomplished using frozen negative saliva samples (in triplicate) and spiking in dilutions of inactivated virus at 10,000 GCE/mL.

The final experiment established ΔRn and Ct cutoffs for assay targets. This was accomplished by running a total of 8, 384-well NTC plates at 3 different lab sites to determine the variability of RNase P background signal between different labs and establish a Ct cutoff settings for the assay. There is inherent variability between labs since human cells, though ubiquitous, exist at varying levels between different laboratories.

Results: once the data were collected, the ΔRn of representative present and absent samples for RNase P was plotted at various cycles to determine a preliminary Ct cutoff and threshold that separates the RNase P present from the RNase P absent samples. Preliminary experiments indicated that a Ct cutoff of 32 for RNase P for samples provided analytical sensitivity and guarded against false calls due to sample inadequacy. Based on these experiments a Ct cutoff of 35 was selected for RNase P in the No Template Control (NTC) and Positive Control (PC) to control for RNase P contamination as these controls should not contain human genomic material. Preliminary experiments further indicated that a Ct cutoff of 37 for SARS-CoV-2 provides analytical sensitivity while addressing low levels of SARS-CoV-2 contamination. It is important to note that high levels of contamination (such as from a cross-contamination event) are difficult to address by thresholds and Ct cutoffs—best practices should be implemented in the lab SOP to prevent contamination.

A summary of the thresholds and Ct cutoffs identified are provided in Table 33 below.

TABLE 33

| Target | Sample Type | Threshold (ΔRn) | Ct cutoff |
|---|---|---|---|
| RNase P | Sample | 0.2 | 32 |
| SARS-CoV-2 | Sample, NTC | 0.1 | 37 |
| RNase P | PC, NTC | 0.2 | 35 |
| SARS-CoV-2 | PC | 0.1 | 37 |

Based on the foregoing, secondary analysis Ct cutoffs were applied for samples (as described in Table 34 below) and for NTC and PC (as described in Table 35 below).

TABLE 34

| Ct Value | | |
|---|---|---|
| SARS-CoV-2 N and S genes (VIC) | RNase P (FAM) | Result |
| ≤37 | ≤32 | Present |
| ≤37 | >32 | Present |
| >37 | ≤32 | Absent |
| >37 | >32 | Re-Test |

TABLE 35

| | Ct Value | |
|---|---|---|
| Control | SARS-CoV-2 N and S genes (VIC) | RNase P (FAM) |
| NTC | >37 | >35 |
| PC | ≤37 | >35 |

To determine the analytical sensitivity, an experiment was performed to determine the genome copy number equivalents per mL (GCE/mL) where greater than 95% of the expected present samples were detected. Gamma irradiated virus was spiked into SARS-CoV-2 negative saliva samples. Samples were then prepared as described in TaqCheck™ SARS-CoV-2 Fast PCR Assay Quick Reference Guide and analyzed by RT-PCR. Data from a representative experiment, analyzed based on the determined threshold and Ct cutoffs contained herein, are presented in Table 36. Based on the results of the experiment, analytical sensitivity was established at 6,000 GCE/mL.

TABLE 36

| Copies (GCE/mL) | # Replicates | # Pos Samples Detected | % Pos |
|---|---|---|---|
| 1000 | 92 | 46 | 50% |
| 3320 | 96 | 87 | 91% |
| 4000 | 300 | 192 | 64% |
| 6000 | 80 | 79 | 99% |
| 6680 | 96 | 93 | 97% |
| 9000 | 60 | 60 | 100% |
| 10000 | 280 | 274 | 98% |
| 12000 | 60 | 60 | 100% |
| 20000 | 161 | 161 | 100% |

Example 10: Discrimination of Variants of SARS-CoV-2 in Biological Samples

In some embodiments, one inherent advantage possessed by the disclosed primers and probes is the ability to discriminate between patient samples that contain the 'normal' or 'reference' version of SARS-nCoV-2, as exemplified in GenBank Accession No: MN908947.3, and patient samples infected by certain viral variants, particularly variants involving deletion of amino acid residue 69 and/or 70 of the Spike protein encoded by the S gene. The disclosed primers and probes can accordingly be used to quickly and cheaply determine whether certain SARS-CoV-2 variants are potentially present in clinical samples during patient intake or triage. Samples that test positive for two out of three viral target sequences (N, S and ORF1ab) are initially classified as positive and selected for further assessment using more extensive and expensive confirmatory methods such as sequencing of the viral genome. As reported in the literature, such primers and probes have been widely used by health facilities in the United Kingdom to obtain an initial indication of whether the B.1.1.7 variant is present in patients.

See, e.g., Public Health England, Technical Briefing 1, Investigation of Novel SARS-COV-2 Variant, Variant of Concern 202012/01, available at https://assets.publishing.service.gov.uk/government/uploads/system/uploads/attachment_data/file/959438/
Technical_Briefing_VOC_SN_NJL2_SH2.pdf.

As an example, samples collected from humans via nasopharyngeal swab, nasopharyngeal aspirate, or bronchoalveolar lavage are tested to determine whether certain variants of SARS-CoV-2 are potentially present. Viral DNA from patient samples is isolated using the MagMAX Viral/Pathogen Nucleic Acid Isolation Kit (sold by Thermo Fisher Scientific under Cat. No. A42356) in accordance with the instructions provided therewith.

The samples are then subjected to multiplex amplification using the exemplary primers and probes specified below and using the master mix and other general components from the TaqPath COVID-19 Combo Kit (Thermo Fisher Scientific, Catalog No. A47814) in accordance with the protocol supplied therewith. Amplification is performed on a QuantStudio 7500 (Thermo Fisher Scientific) and amplification of the N, S and ORF1ab target sequences monitored using the VIC, ABY and FAM probe labels, respectively, while the positive control (MS2) was monitored using a JUN probe label.

TABLE 37

| | FOR primer | REV primer | Probe |
|---|---|---|---|
| ORF1ab | SEQ ID NO: 160 | SEQ ID NO: 468 | SEQ ID NO: 1049 |
| S | SEQ ID NO: 100 | SEQ ID NO: 337 | SEQ ID NO: 864 |

TABLE 37-continued

| | FOR primer | REV primer | Probe |
|---|---|---|---|
| N | SEQ ID NO: 211 | SEQ ID NO: 510(mod) | SEQ ID NO: 833 |

The resulting data are analyzed using the COVID Interpretive Software released by Thermo Fisher Scientific. For each plate, the control reactions are confirmed to perform as expected (i.e., the no template control have an undetermined $C_t$ value and the positive control has a $C_t$ value less than or equal to 30).

The Ct cutoff for viral samples is set to 37. If the $C_t$ value for each of the N, S and ORF1ab target sequences is determined, the sample called as positive for a target sequence where the Ct value for that target sequence is equal to, or less than, 37. In several samples, the results were positive for the N and ORF1ab gene target sequences but negative for the S gene target sequence.

Samples that test positive for two or more SARS-CoV-2 target sequences are classified as having a valid result; those only showing positive for two of the three SARS-CoV-2 target sequences are recommended for further testing by the health authorities. These can typically, but not necessarily, include samples that test positive for both the N and ORF1ab gene target sequences while testing negative for the S gene target sequence.

CONCLUSION

The present disclosure may be embodied in other specific forms without departing from its spirit or essential characteristics. The described embodiments are to be considered in all respects only as illustrative and not restrictive. The scope of the invention is, therefore, indicated by the appended claims rather than by the foregoing description. While certain embodiments and details have been included herein and in the attached disclosure for purposes of illustrating embodiments of the present disclosure, it will be apparent to those skilled in the art that various changes in the methods, products, devices, and apparatuses disclosed herein may be made without departing from the scope of the disclosure or of the invention. Thus, while various aspects and embodiments have been disclosed herein, other aspects and embodiments are contemplated. All changes that come within the meaning and range of equivalency of the claims are to be embraced within their scope.

The subsequent items are a list of preferred embodiments:
1. A method for detecting SARS-CoV-2 in a nucleic acid sample, comprising:
    (a) creating a reaction mixture containing the nucleic acid sample, a forward primer, and a reverse primer; and
    (b) subjecting the reaction mixture to reaction conditions suitable to perform a polymerase chain reaction (PCR).
2. The method of item 1, further including generating one or more amplicons via PCR.
3. The method of item 1 or item 2, wherein the reaction mixture further includes a probe containing a fluorescent reporter and a corresponding quencher.
4. The method of any one of items 1-3, further including monitoring the fluorescence produced during the PCR.
5. The method of any preceding item, further including determining the amount of nucleic acid present in the sample.
6. The method of any preceding item, wherein the forward primer and the reverse primer bind to a region of the coronavirus genome wherein the homology of the region between SARS-CoV-2 and bat-SL-CoVZC45 is less than 50%, 20%, 10% or 5%.
7. The method of item 6, wherein the region is within the ORF1ab gene, the S protein gene, or the N protein gene of the SARS-CoV-2 genome.
8. The method of any preceding item, wherein the forward primers are selected from SEQ ID NO:4-SEQ ID NO:251.
9. The method of any preceding item, where in the reverse primers are selected from SEQ ID NO:267-SEQ ID NO:504.
10. The method of item any preceding item, wherein the probe sequence is selected from SEQ ID NO:520-SEQ ID NO:1295.
11. The method of any one of items 3-10, wherein the probe is labeled at the 5' end with a dye selected from 6FAM, ABY, VIC, JUN, and FAM.
12. The method of item 11, wherein the probe is labeled at the 3' end with a quencher selected from QSY, BHQ (Black Hole Quencher), and DFQ (Dark Fluorescent Quencher).
13. The method of any preceding item, wherein a positive control and a negative control are analyzed in conjunction with the sample.
14. The method of item 13, wherein a nucleic acid template for the positive control is a synthetic plasmid comprising sequences from the SARS-CoV-2 ORF1ab gene, the SARS-CoV-2 S protein gene, the SARS-CoV-2 N protein gene, and/or a human RNase P gene.
15. A composition for detecting the presence of SARS-CoV-2 from a nucleic acid sample, comprising a nucleic acid primer and/or probe containing a nucleic acid sequence of a target region, the nucleic acid primer and/or probe comprising a primer and/or probe within SEQ ID NO:4-SEQ ID NO:251. SEQ ID NO:267-SEQ ID NO:504, and SEQ ID NO:520-SEQ ID NO:1295.
16. The composition of item 15, wherein the nucleic acid primer is a first forward primer configured to hybridize to one end of a first target sequence within a first target region in the SARS-CoV-2 viral RNA genome, or to a complement of the first target sequence.
17. The composition of item 15 or 16, wherein the nucleic acid sequence of the target region is SEQ ID NO:1.
18. The composition of item 15 or 16, wherein the nucleic acid sequence of the target region is SEQ ID NO:2.
19. The composition of item 15 or 16, wherein the nucleic acid sequence of the target region is SEQ ID NO:3.
20. The composition of any one of items 15-19, further including a first reverse primer configured to hybridize to the other end of the first target sequence or its complement.
21. The composition of any one of items 15-20, further including the nucleic acid sample, a polymerase, a buffer, and dNTPs.
22. The composition of any one of items 15-21, further including a first probe containing a detectable label.
23. The composition of item 22, wherein the detectable label is a fluorescent label and the first probe further includes a quencher that quenches the fluorescent label.
24. The composition of item 22 or item 23, wherein the first probe is configured to hybridize to a first target subsequence that is complementary or identical to at least 10 contiguous nucleotides within the first target sequence, a DNA copy thereof, or to a complement of the first target sequence or its DNA copy.
25. A composition for amplifying one or more target sequences in the SARS-CoV-2 genome, comprising: a first forward primer and a first reverse primer configured to amplify a first target sequence present in a first target region of the SARS-CoV-2 genome, wherein the first target sequence includes at least 10 contiguous nucleotides of the first target region, the first target region having less than 50%, 40%, 30%, 20%, or 10% identity with an analogous region in bat-SL-CoVZC45.

26. The composition of item 25, wherein the first forward primer and the first reverse primer are configured to hybridize to different ends of the first target sequence, a DNA copy thereof, or their respective complements, and form an amplicon therebetween.

27. The composition of item 25 or item 26, wherein the nucleic acid sequence of the first target region is SEQ ID NO:1.

28. The composition of item 25 or item 26, wherein the nucleic acid sequence of the first target region is SEQ ID NO:2.

29. The composition of item 25 or item 26, wherein the nucleic acid sequence of the first target region is SEQ ID NO:3.

30. The composition of any one of items 25-29, further including a nucleic acid sample, a polymerase, a buffer, and dNTPs.

31. The composition of any one of items 25-30, further including a first probe containing a detectable label.

32. The composition of item 31, wherein the detectable label is a fluorescent label and the first probe further includes a quencher that quenches the fluorescent label.

33. The composition of item 31 or 32, wherein the first probe is configured to hybridize to a first target subsequence that is complementary or identical to at least 10 contiguous nucleotides of the first target sequence, a DNA copy thereof, or their respective complements.

34. The composition of item 33, further including a second forward primer and a second reverse primer configured to amplify a second target sequence within a second target region of the SARS-CoV-2 genome.

35. The composition of item 34, wherein the second forward primer and the second reverse primer are configured to bind to different ends of the second target sequence or to a cDNA complement thereof.

36. The composition of item 34 or 35, wherein the nucleic acid sequence of the first target region and the second target region are different and are selected from SEQ ID NO:1, SEQ ID NO:2, and SEQ ID NO:3.

37. The composition of item 36, further including a third forward primer and a third reverse primer configured to amplify a third target sequence within a third target region of the SARS-CoV-2 genome.

38. The composition of item 37, wherein the third forward primer and the third reverse primer are configured to bind to different ends of the third target sequence or to a DNA copy or DNA complement thereof 39. The composition of item 38, wherein the nucleic acid sequence of the first target region, the second target region, and the third target region are different and are selected from SEQ ID NO:1, SEQ ID NO:2, and SEQ ID NO:3.

40. The composition of any one of items 26-39, wherein the primer sequences specific for the first target sequence are selected from SEQ ID NOs: 4, 320, 34, 423, 160 and 468.

41. The composition of any one of items 34-40, wherein the primer sequences specific for the second target sequence are selected from SEQ ID NOs: 5, 441, 100 and 337.

42. The composition of any one of items 37-41, wherein the primer sequences specific for the third target sequence are selected from SEQ ID NOs: 248, 487, 211 and 501.

43. A composition useful as an amplification control in a reaction to detect SARS-CoV-2 nucleic acid, Influenza (Flu) type A and/or Influenza (Flu) type B nucleic acid, and/or Respiratory Syncytia Virus (RSV) nucleic acid in a sample, comprising a linear or circular nucleic acid molecule including, in any order, at least one target sequence derived from the N gene of SARS-CoV-2, at least one further target sequence derived from the S gene of SARS-CoV-2, and optionally at least one target sequence derived from the ORF1ab gene of SARS-CoV-2.

44. A kit for detecting SARS-CoV-2 nucleic acid, Influenza (Flu) type A and/or Influenza (Flu) type B nucleic acid, and/or Respiratory Syncytia Virus (RSV) nucleic acid in a sample, comprising a composition of any one of items 15-43, or any combinations thereof.

45. The kit of item 44, further including a PCR master mix.

46. The kit of item 45, wherein the master mix is TaqMan Fast Virus 1-Step Master Mix or TaqPath 1-Step RT-qPCR Master Mix, CG.

47. The kit of any one of items 44-46, wherein at least one of the components is dried or freeze dried.

48. The kit of any of items 44-47, further including an array of qPCR assays, each qPCR assay situated in a different locus of the array.

49. The kit of item 48, wherein the different locus includes a well, channel, groove, cavity, site, or feature formed on a surface of the array.

50. A method of detecting SARS-CoV-2 viral nucleic acid present in a sample, comprising:
(a) providing a composition according to any one of items 15-43;
(b) forming a reaction volume by contacting the composition, in any order or combination, with a polymerase, dNTPs, and a nucleic acid sample obtained from bodily tissue taken from an organism; and
(c) forming one or more amplification products containing amplified SARS-CoV-2 sequences in the reaction volume, wherein the forming includes subjecting the reaction volume to amplification conditions suitable to amplify target SARS-CoV-2 sequences from SARS-CoV-2 nucleic acid present in the nucleic acid sample prior to amplification.

51. The method of item 50, further including detecting at least one of the amplification products during or after the forming step.

52. The method of item 50 or 51, further including diagnosing a SARS-CoV-2 infection in the organism.

53. The method of any one of items 50-52, wherein the organism is a human subject and the nucleic acid sample is derived from SARS-CoV-2.

54. The method of any one of items 50-53, wherein the forming includes amplifying at least three different and specific SARS-CoV-2 target sequences from the nucleic acid sample.

55. The method of item 54, wherein the at least three different three different SARS-CoV-2 target sequences include one target sequence derived from the N gene, one target sequence derived from the S gene, and one target sequence derived from the ORF1ab gene.

56. The method of item 13 or any one of items 50 to 54, wherein the positive control is an exogenous RNA sequence or an endogenous DNA or RNA sequence.

57. The method of item 56, wherein the exogenous RNA sequence is an MS2 bacteriophage sequence and wherein the endogenous DNA or RNA sequence is a human RNase P sequence.

58. The method of item 56 or 57, further comprising a second positive control selected from an exogenous RNA sequence and an endogenous nucleic acid sequence.

59. The method of any one of items 1-14 or 50-58, wherein the method further includes detecting a target sequence derived from the influenza type A (Flu A) and/or influenza type B (Flu B) virus in the nucleic acid sample.

60. The method of item 59, wherein the detecting comprises the use of a forward primer selected from SEQ ID NO:252, SEQ ID NO:253, or SEQ ID NO:257; a reverse primer selected from SEQ ID NO:505 and SEQ ID NO:506; and/or a probe selected from SEQ ID NO:1296 and SEQ ID NO:1297.

61. The method of any one of items 1-14 or 50-60, wherein detection of SARS-CoV-2 and/or Flu A and/or Flu B in the nucleic acid sample is detected down to at least a 10 genomic copy equivalent per reaction (GCE/rxn).

62. The method of any one of items 1-14 or 50-60, wherein detection of SARS-CoV-2 and/or Flu A and/or Flu B in the nucleic acid sample is detected over a linear dynamic range (LDR) of detection from $10^7$ to 10 GCE/rxn.

63. The method of any one of items 1-14 or 50-60, wherein detection of SARS-CoV-2 in the nucleic acid sample is detected down to 1-10 copies/µL per reaction.

64. The method of any one of items 1-14 or 50-60, wherein detection of SARS-CoV-2 in the nucleic acid sample is detected over a linear dynamic range (LDR) of at least 5 logs.

65. A composition for detecting the presence of SARS-CoV-2 and Influenza type A (Flu A) and/or Influenza type B (Flu B) in a nucleic acid sample, comprising at least two pairs of nucleic acid primers, each pair of nucleic acid primers having a forward primer and a reverse primer selected, respectively, from SEQ ID NO:4-SEQ ID NO:257 and SEQ ID NO:267-SEQ ID NO:510, and, optionally, at least two nucleic acid probes containing a nucleic acid sequence selected from any of SEQ ID NO:520-SEQ ID NO:2533.

66. The method, kit or composition of any one of the preceding items, wherein the probe is a FAM-labeled probe directed to the ORF1ab gene of SARS-CoV-2.

67. The method, kit or composition of any one of the preceding items, wherein the probe is a VIC-labeled probe directed to the N protein gene of SARS-CoV-2.

68. The method, kit or composition of any one of the preceding items 1, wherein the probe is an ABY-labeled probe directed to the S protein gene of SARS-CoV-2.

69. The method, kit or composition of any one of the preceding items, wherein the positive control is an MS2 qPCR assay comprising a JUN-labeled probe directed to a portion of the MS2 nucleic acid present in the MS2 qPCR assay.

70. A method for the detection of SARS-CoV-2 in a nucleic acid sample, comprising:
    (a) creating a reaction mixture containing the nucleic acid sample, a forward primer, and a reverse primer; and
    (b) subjecting the reaction mixture to reaction conditions suitable to perform a loop-mediated isothermal amplification (LAMP).

71. The method of any one of items 1-14, 50-64, and 66-70, wherein the method comprises a point-of-service (POS) system.

72. The method of any one of items 1-14, 50-64, and 66-70, wherein the nucleic acid sample is collected at a point of care (POC) location, and/or is analyzed in a device at the POC location.

73. The method of item 71, wherein the device at the POC location is configured to analyze a small-volume clinical sample in a short period of time, such as less than 1-2 hours.

74. The method of item 71 or item 72, wherein the method is performed on the POS system at the POC location.

75. The method of item 71 or item 72, wherein the nucleic acid sample is obtained at the POC location.

76. The method of item 71 or item 72, wherein the method is used for analyzing a clinical sample at the POC location.

77. The method of item 71 or item 72, wherein the POS method includes performing a plurality of assays on a single small volume clinical sample, or on aliquots thereof 78. The method of item 71, wherein the POS system is implemented at a POS location, and wherein the method is performed in a short period of time.

79. The method of item 71, wherein the methods are implemented at the POS system at the POS location, wherein the methods are for performing a plurality of assays on a single small volume clinical sample, or on aliquots thereof, and may be performed in a short period of time.

80. The method of item 78 or item 79, wherein the short period of time is less than 24 hours.

81. The method, kit or composition of any one of the preceding items, wherein the PCR is a reverse transcription PCR (RT-PCR).

82. The method, kit or composition of any one of the preceding items, wherein a forward RNase P primer comprises SEQ ID NO:2552, a reverse RNase P primer comprises SEQ ID NO:2553, and/or an RNase P probe is selected from SEQ ID NO:2554-SEQ ID NO:2556.

83. The method of any one of items 1-14 or 50-64 or 66-82, wherein the method further includes detection of a Respiratory Syncytial Virus (RSV) specific target within the nucleic acid sample.

84. The method of item 83, wherein detection of RSV comprises detecting RSV type A and/or RSV type B using a forward primer selected from SEQ ID NO:254 and SEQ ID NO:255, a reverse primer selected from SEQ ID NO:507 and SEQ ID NO:508, and/or a probe selected from SEQ ID NO:1298 and SEQ ID NO:1299.

85. The method of any one of items 1-14 or 50-64 or 66-84, wherein detection of SARS-CoV-2, Flu A and/or Flu B, and/or RSV A and/or RSV B in the nucleic acid sample is detected down to at least a 10 genomic copy equivalent per reaction (GCE/rxn).

86. The method of any one of items 1-14 or 50-64 or 66-84, wherein detection of SARS-CoV-2, Flu A and/or Flu B, and/or RSV A and/or RSV B in the nucleic acid sample is detected over a linear dynamic range of detection from $10^7$ to 10 GCE/rxn.

87. The method of any one of items 1-14 or 50-64 or 66-84, wherein the method further includes detection of influenza type A (Flu A) virus, influenza type B (Flu B) virus, Respiratory Syncytial Virus type A (RSV A), and/or Respiratory Syncytial Virus type B (RSV B) in the nucleic acid sample.

88. The method of item 87, wherein the SARS-CoV-2 probes comprise a VIC dye and QSY quencher, the Flu A/B probes comprise FAM dye and QSY quencher, and the RSV A/B probes comprise an ABY dye and QSY quencher.

89. A method for detecting SARS-CoV-2 as disclosed herein.

90. The method of any one of items 1-14, 50-64, or 66-89, wherein the sample comprises a saliva sample.

91. The method of item 89 or item 90, wherein the method does not include a step for purifying or extracting a nucleic-acid-containing portion away from the sample.

92. The method of any one of items 89-91, wherein the detection of SARS-CoV-2 within the sample is performed via a nucleic acid amplification reaction utilizing the unpurified sample as a probative template.

93. The method of item 92, further comprising heating the sample for a period of time sufficient to inactivate nucleases within the sample and/or to rupture eukaryotic cells, denature viral capsids, and/or disrupt a membrane portion of enveloped virions therein.

94. The method of any one of items 89-93, further comprising heating the unpurified sample to a temperature at or above about 80° C., preferably at or above about 90° C., more preferably at or above about 95° C.

95. The method of item 94, wherein the unpurified sample is heated for at least 5, 10, 15, 20, 25, 30, 35, or 40 minutes or for any range of time formed by an upper and lower bound selected therefrom.

96. The method of any one of items 90-95, further comprising combining the sample with a lysis buffer.

97. The method of any one of items 93-96, further comprising mixing the heat-treated sample prior to and/or after combining the heat-treated sample with the lysis buffer.

98. The method of item 96 or 97, wherein the lysis buffer comprises a nucleic-acid-amenable buffer and a detergent and/or emulsifier.

99. The method of any one of items 96-98, wherein the lysis buffer comprises a combination of TBE buffer and a polysorbate-type nonionic surfactant, such as Tween-20.

100. The method of any one of items 89-99, wherein the sample comprises a pooled-subject sample.

101. The method of any one of items 89-100, wherein detecting SARS-CoV-2 within the sample occurs in less than about 3 hours from the time the sample is received, preferably less than about 2 hours.

102. A method for the detection of the SARS-CoV-2 coronavirus in a nucleic acid sample comprising:
   (a) heating a sample for 15-45 minutes, preferably about 30 minutes, at 95° C.;
   (b) mixing the heat-treated sample with a lysis solution to form a volume of probative template;
   (c) creating a nucleic acid amplification reaction mixture comprising at least a portion of the volume of probative template, one or more primers specific and/or diagnostic for SARS-CoV-2, and a nucleic acid polymerase; and
   (d) subjecting the nucleic acid amplification reaction mixture to conditions suitable to generate SARS-CoV-2-specific amplicons if SARS-CoV-2 nucleic acid is present in the sample.

103. The method of item 102, further comprising receiving a sample.

104. The method of item 103, wherein receiving the sample comprises receiving a sample collection device or other container comprising the sample.

105. The method of item 104, wherein the sample collection device is a sealable tube.

106. The method of any one of items 103-105, wherein the sample is received following self-collection of the sample by the subject.

107. The method of any one of items 103-106, wherein receiving the sample comprises receiving a raw saliva sample.

108. The method of any one of items 102-107, further comprising vortexing the heat-treated sample.

109. The method of any one of items 102-108, further comprising detecting the amplicons, or one or more detectable labels associated with generation of the amplicons, while subjecting the nucleic acid amplification reaction mixture to the conditions suitable for generating the amplicons.

110. The method of any one of items 102-108, further comprising detecting the amplicons, or one or more detectable labels associated with generation of the amplicons, after the nucleic acid amplification reaction mixture is subjected to the conditions suitable for generating the amplicons.

111. The method of any one of items 102-110, further comprising equilibrating the heat-treated sample to room temperature prior to mixing the heat-treated sample with the lysis solution.

112. The method of any one of the preceding items, wherein the sample is received following self-collection by the sample provider.

113. The method of any one of the preceding items, wherein the sample is received following collection by an individual other than the sample provider.

114. The method of any one of the preceding items, wherein one or more of the method steps are performed using a sample collection device.

115. The method of item 114, wherein at least the steps of receiving and heating are performed using the sample collection device.

116. The method of any one of the preceding items, wherein the method is used for asymptomatic testing and/or high-frequency or widespread screening.

117. A composition for use in methods of detecting viral nucleic acid, the composition comprising a heat-treated sample.

118. The composition of item 117, wherein the heat-treated sample comprises heat-treated raw saliva.

119. The composition of item 117 or item 118, further comprising a buffer.

120. The composition of item 119, wherein the buffer comprises TBE.

121. The composition of any one of items 117-120, further comprising a detergent and/or emulsifier.

122. The composition of item 121, wherein the detergent and/or emulsifier comprises a polysorbate-type nonionic surfactant.

123. The composition of any one of items 117-122, further comprising one or more PCR reagents.

124. The composition of item 123, wherein the one or more PCR reagents comprise one or more primers or probes for amplifying specific viral nucleic acid sequences as described herein.

125. The composition of item 123 or item 124, wherein the one or more PCR reagents comprise a PCR master mix or components thereof 126. The method, composition or kit of any one of the preceding items, wherein the nucleic acid sample is derived from a non-human animal.

127. The method, composition or kit of any one of the preceding items, wherein the nucleic acid sample is derived from a mammal.

128. The method, composition or kit of any one of item 127, wherein the nucleic acid sample is derived from a mink, cat, dog, ferret, hamster, bat, primate, such as Rhesus macaques, cynomolgus macaques, grivets, and common marmosets, zoo animal, laboratory animal or farm animal.

129. The method, composition or kit of any one of the preceding items, wherein the reverse and forward primer sequences specific for the first target sequence are selected from SEQ ID NOs: 248 and 487, or 211 and 501.

130. The method, composition or kit of any one of the preceding items wherein the reverse and forward primer sequences specific for the second target sequence are selected from SEQ ID NOs: 5 and 441, or 100 and 337.

131. The method, composition or kit of any one of the preceding items, wherein the reverse and forward primer sequences specific for the third target sequence are selected from SEQ ID NOs: 4 and 320, or 34 and 423, or 160 and 468.

132. The method, composition or kit of any one of the preceding items, wherein the reverse and forward primer sequences specific for the first, second and/or third target sequence are:
SEQ ID NOs: 4 and 320, SEQ ID NOs: 5 and 441 and/or SEQ ID NOs: 248 and 487;
SEQ ID NOs: 34 and 423, SEQ ID NOs: 5 and 441 and/or SEQ ID NOs: 248 and 487;
SEQ ID NOs: 160 and 468, SEQ ID NOs: 5 and 441 and/or SEQ ID NOs: 248 and 487;
SEQ ID NOs: 4 and 320, SEQ ID NOs: 100 and 337 and/or SEQ ID NOs: 248 and 487;
SEQ ID NOs: 34 and 423, SEQ ID NOs: 100 and 337 and/or SEQ ID NOs: 248 and 487;
SEQ ID NOs: 160 and 468, SEQ ID NOs: 100 and 337 and SEQ ID NOs: 248 and 487
SEQ ID NOs: 4 and 320, SEQ ID NOs: 5 and 441 and SEQ ID NOs: 211 and 501;
SEQ ID NOs: 34 and 423, SEQ ID NOs: 5 and 441 and SEQ ID NOs: 211 and 501;
SEQ ID NOs: 160 and 468, SEQ ID NOs: 5 and 441 and SEQ ID NOs: 211 and 501;
SEQ ID NOs: 4 and 320, SEQ ID NOs: 100 and 337 and SEQ ID NOs: 211 and 501;
SEQ ID NOs: 34 and 423, SEQ ID NOs: 100 and 337 and SEQ ID NOs: 211 and 501; or
SEQ ID NOs 160 and 468, SEQ ID NOs: 100 and 337 and SEQ ID NOs: 211 and 501.

133. The method, composition or kit of any one of the preceding items, wherein the probe is selected from the group consisting of SEQ ID NO: 565, 599, 971, 930, 1160, 1106, 1203, 1049, 864 and/or 833.

134. The method, composition or kit of any one of the preceding items, wherein any one of the reverse and forward primer sequences specific for the first, second or third target sequence is SEQ ID NO: 248.

135. The method, composition or kit of any one of the preceding items, wherein any one of the reverse and forward primer sequences specific for the first, second or third target sequence is SEQ ID NO: 487.

136. The method, composition or kit of any one of the preceding items, wherein any one of the reverse and forward primer sequences specific for the first, second or third target sequence is SEQ ID NO: 211.

137. The method, composition or kit of any one of the preceding items, wherein any one of the reverse and forward primer sequences specific for the first, second or third target sequence is SEQ ID NO: 501.

138. The method, composition or kit of any one of the preceding items, wherein any one of the reverse and forward primer sequences specific for the first, second or third target sequence is SEQ ID NO: 5.

139. The method, composition or kit of any one of the preceding items, wherein any one of the reverse and forward primer sequences specific for the first, second or third target sequence is SEQ ID NO: 441.

140. The method, composition or kit of any one of the preceding items, wherein any one of the reverse and forward primer sequences specific for the first, second or third target sequence is SEQ ID NO: 100.

141. The method, composition or kit of any one of the preceding items, wherein any one of the reverse and forward primer sequences specific for the first, second or third target sequence is SEQ ID NO: 337.

142. The method, composition or kit of any one of the preceding items, wherein any one of the reverse and forward primer sequences specific for the first, second or third target sequence is SEQ ID NO: 160.

143. The method, composition or kit of any one of the preceding items, wherein any one of the reverse and forward primer sequences specific for the first, second or third target sequence is SEQ ID NO: 468.

144. The method, composition or kit of any one of the preceding items, wherein any one of the reverse and forward primer sequences specific for the first, second or third target sequence is SEQ ID NO: 4.

145. The method, composition or kit of any one of the preceding items, wherein the probe is SEQ ID NO: 565.

146. The method, composition or kit of any one of the preceding items, wherein the probe is SEQ ID NO: 599.

147. The method, composition or kit of any one of the preceding items, wherein the probe is SEQ ID NO: 971.

148. The method, composition or kit of any one of the preceding items, wherein the probe is SEQ ID NO: 930.

149. The method, composition or kit of any one of the preceding items, wherein the probe is SEQ ID NO: 1160.

150. The method, composition or kit of any one of the preceding items, wherein the probe is SEQ ID NO: 1106.

151. The method, composition or kit of any one of the preceding items, wherein the probe is SEQ ID NO: 1203.

152. The method, composition or kit of any one of the preceding items, wherein the probe is SEQ ID NO: 1049.

153. The method, composition or kit of any one of the preceding items, wherein the probe is SEQ ID NO: 864.

154. The method, composition or kit of any one of the preceding items, wherein the probe is SEQ ID NO: 833.

155. The method, composition or kit of any one of the preceding items, wherein any one of the reverse and forward primer sequences specific for the first, second or third target sequence is SEQ ID NO: 320.

156. The method, composition or kit of any one of the preceding items, wherein any one of the reverse and forward primer sequences specific for the first, second or third target sequence is SEQ ID NO: 34.

157. The method, composition or kit of any one of the preceding items, wherein any one of the reverse and forward primer sequences specific for the first, second or third target sequence is SEQ ID NO: 423.

158. The method, composition or kit of any one of the preceding items, comprising a first forward primer of SEQ ID NO: 160 and a first reverse primer of SEQ ID NO: 468.

159. The method, composition or kit of item 134, further comprising a probe of SEQ ID NO: 1049.
160. The method, composition or kit of any one of the preceding items, comprising a second forward primer of SEQ ID NO: 100 and a second reverse primer of SEQ ID NO: 337.
161. The method, composition or kit of item 136, further comprising a probe of SEQ ID NO: 864.
162. The method, composition or kit of any one of the preceding items, comprising a third forward primer of SEQ ID NO: 211 and a third reverse primer of SEQ ID NO: 501 and/or 510.
163. The method, composition or kit of item 138, further comprising a probe of SEQ ID NO: 833.
164. The method, composition or kit of any one of the preceding items useful for amplifying and/or detecting a region of the ORF1ab gene of SARS-CoV-2, comprising: a forward primer of SEQ ID NO: 160, a reverse primer of SEQ ID NO: 468, and a probe of SEQ ID NO: 1049.
165. The method, composition or kit of any one of the preceding items useful for amplifying and/or detecting a region of the S gene of SARS-CoV-2, comprising: a forward primer of SEQ ID NO: 100, a reverse primer of SEQ ID NO: 337, and a probe of SEQ ID NO: 864.
166. The method, composition or kit of any one of the preceding items useful for amplifying and/or detecting a region of the N gene of SARS-CoV-2, comprising: a forward primer of SEQ ID NO: 211, a reverse primer of SEQ ID NO: 501, and a probe of SEQ ID NO: 833.
167. The method, composition or kit of any one of the preceding items useful for amplifying and/or detecting a region of the N gene of SARS-CoV-2, comprising: a forward primer of SEQ ID NO: 211, a reverse primer of SEQ ID NO: 510, and a probe of SEQ ID NO: 833.
168. The method, composition or kit of any one of the preceding items useful for multiplex detection of target sequences derived from the S gene and the N gene of SARS-CoV-2, comprising:
   (i) a first forward primer of SEQ ID NO: 211, a first reverse primer of SEQ ID NO: 501, and a first probe of SEQ ID NO: 833; and
   (ii) a second forward primer of SEQ ID NO: 100, a second reverse primer of SEQ ID NO: 337, and a second probe of SEQ ID NO: 864.
169. The method, composition or kit of any one of the preceding items useful for multiplex detection of target sequences derived from the S gene and the N gene of SARS-CoV-2, comprising:
   (i) a first forward primer of SEQ ID NO: 211, a first reverse primer of SEQ ID NO: 510, and a first probe of SEQ ID NO: 833; and
   (ii) a second forward primer of SEQ ID NO: 100, a second reverse primer of SEQ ID NO: 337, and a second probe of SEQ ID NO: 864.
170. The method, composition or kit of any one of the preceding items useful for multiplex detection of target sequences derived from the S gene, N gene and ORF1ab genes of SARS-CoV-2, comprising:
   (i) a first forward primer of SEQ ID NO: 160, a first reverse primer of SEQ ID NO: 468, and a first probe of SEQ ID NO: 1049;
   (ii) a second forward primer of SEQ ID NO: 100, a second reverse primer of SEQ ID NO: 337, and a second probe of SEQ ID NO: 864; and
   (iii) a third forward primer of SEQ ID NO: 211, a third reverse primer of SEQ ID NO: 501, and a third probe of SEQ ID NO: 833.
171. The method, composition or kit of any one of the preceding items useful for multiplex detection of target sequences derived from the S gene, N gene and ORF1ab genes of SARS-CoV-2, comprising:
   (i) a first forward primer of SEQ ID NO: 160, a first reverse primer of SEQ ID NO: 468, and a first probe of SEQ ID NO: 1049;
   (ii) a second forward primer of SEQ ID NO: 100, a second reverse primer of SEQ ID NO: 337, and a second probe of SEQ ID NO: 864; and
   (iii) a third forward primer of SEQ ID NO: 211, a third reverse primer of SEQ ID NO: 510, and a third probe of SEQ ID NO: 833.
172. The composition or kit of any one of the preceding items, further comprising a primer selected from SEQ ID NOs:252, 253, or 257.
173. The composition or kit of any one of the preceding items, further comprising a primer selected from SEQ ID NOs: 505 and 506.
174. The composition or kit of any one of the preceding items, further comprising a probe selected from SEQ ID NOs:1296 and 1297.
175. The composition or kit of any one of the preceding items, further comprising a primer selected from SEQ ID NOs:254 and 255.
176. The composition or kit of any one of the preceding items, further comprising a primer selected from SEQ ID NOs:507 and: 508.
177. The composition or kit of any one of the preceding items, further comprising an oligonucleotide selected from SEQ ID NOs:1298 and 1299.
178. The composition or kit of any one of the preceding items, further comprising an oligonucleotide selected from SEQ ID NOs:2552 and 2553.
179. The composition or kit of any one of the preceding items, further comprising an oligonucleotide selected from SEQ ID NOs:2554, 2555 and 2556.
180. The composition or kit of any one of the preceding items, further comprising one or more oligonucleotides selected from SEQ ID NO:256, 509 and 1300.
181. The composition or kit of any one of the preceding items, wherein any one or more of the primers and probes includes a fluorescent dye label.
182. The composition or kit of any one of the preceding items, wherein any one or more of the primers and probes includes a fluorescent dye label selected from the group consisting of: VIC, ABY, FAM and JUN.
183. A method for using the composition or kit of any one of the preceding items, comprising amplifying a target sequence using the composition or kit; and detecting the target sequence.
184. The method of item 183, further including determining whether a biological sample includes DNA or RNA from a virus.
185. The method of item 184, further including diagnosing a viral infection in the subject from which the biological sample was derived.
186. The method of item 185, further including diagnosing a specific viral infection in the subject from which the biological sample was derived.
187. The method of items any of items 183-186, further including ruling out a specific viral infection in the subject from which the biological sample was derived.
188. A method for the detection of the SARS-CoV-2 coronavirus in a nucleic acid sample comprising:
   (a) creating a reaction mixture containing the sample, a forward primer and a reverse primer; and (b) subjecting the reaction mixture to reaction conditions suitable to perform a polymerase chain reaction (PCR).
189. The method of item 188, further including generating one or more amplicons via PCR.
190. The method of item 188 or 189, wherein the reaction mixture further includes a probe containing a fluorescent reporter and a corresponding quencher.
191. The method of any of items 188-190, further including monitoring and/or detecting the fluorescence produced during the PCR.
192. The method of item 191, further including determining the amount of nucleic acid present in the sample.
193. The method of item 188, wherein the forward primer and the reverse primer bind to a region of the coronavirus genome wherein the homology between the SARS-CoV-2 coronavirus and the bat-SL-CoVZC45 coronavirus is less than 50%, 20%, 10% or 5%.
194. The method of item 193, wherein the region of the coronavirus having less than 50% homology between the SARS-CoV-2 coronavirus and the bat-SL-CoVZC45 coronavirus is within the orf1ab gene, the S protein gene or the N protein gene of the coronavirus genome.
195. The method of item 193 or 194, wherein the forward primers are selected from SEQ ID NO. 4-SEQ ID NO. 251.
196. The method of item 193 or 194, where in the reverse primers are selected from SEQ ID NO. 267-SEQ ID NO. 504.
197. The method of item 193 or 194, wherein the probe sequence is selected from SEQ ID NO. 520-SEQ ID NO. 1295.
198. The method of item 197, wherein the probe is labeled at the 5' end with a dye selected from 6FAM, ABY, VIC, JUN and FAM.
199. The method of item 198, wherein the probe is labeled at the 3' end with a quencher selected from QSY, BHQ (Black Hole Quencher) and DFQ (Dark Fluorescent Quencher).
200. The method of item 193 or 194, wherein a positive control and a negative control are analyzed in conjunction with the sample.
201. The method of item 200, where in the positive control is a synthetic plasmid comprising targets from the coronavirus orf1ab gene, the S protein gene, the N protein gene and RNase P.
202. A composition for detecting the presence of SARS-CoV-2 in a DNA sample, comprising a nucleic acid primer containing a nucleic acid sequence selected from the group comprising any of the primers disclosed herein.
203. The composition of item 202, wherein the nucleic acid primer is a first forward primer configured to hybridize to one end of a first target sequence within a first target region in the SARS-CoV-2 viral RNA genome, or to a complement of the first target sequence.
204. The composition of item 202, wherein the nucleic acid sequence of the target region is SEQ ID NO: 1.
205. The composition of item 202, wherein the nucleic acid sequence of the target region is SEQ ID NO: 2.
206. The composition of item 202, wherein the nucleic acid sequence of the target region is SEQ ID NO: 3.
207. The composition of item 202-206, further including a first reverse primer configured to hybridize to the other end of the first target sequence or its complement.
208. The composition of any of the preceding items, further including a nucleic acid sample, a polymerase, a buffer and nucleotides.
209. The composition of any of items 202-208, further including a first probe containing a fluorescent or other detectable label.
210. The composition of item 209, wherein the label of the first probe is a fluorescent label and the oligonucleotide probe further includes a quencher that quenches the fluorescent label.
211. The composition of item 209 or 210, wherein the first probe is configured to hybridize to a first target subsequence that is complementary or identical to at least 10 contiguous nucleotides within the first target sequence, a DNA copy thereof, or to a complement of the first target sequence or its DNA copy.
212. A composition for amplifying one or more target sequences in the SARS-CoV-2 genome, comprising: a first forward primer and a first reverse primer configured to amplify a first target sequence present in a first target region of the SARS-CoV-2 genome, wherein the first target sequence includes at least 10 contiguous nucleotides of the first target region, the first target region having less than 50%, 40%, 30%, 20% or 10% identity with bat-SL-CoVZC45 coronavirus and with SARS-CoV-2.
213. The composition of item 212, wherein the first forward primer and the first reverse primer are configured to hybridize to different ends of the first target sequence, a DNA copy thereof, or their respective complements.
214. The composition of item 212 or 213, wherein the nucleic acid sequence of the first target region is SEQ ID NO: 1.
215. The composition of item 212 or 213, wherein the nucleic acid sequence of the first target region is SEQ ID NO: 2.
216. The composition of item 212 or 213, wherein the nucleic acid sequence of the first target region is SEQ ID NO: 3.
217. The composition of any of items 212-217, further including a nucleic acid sample, a polymerase, a buffer and nucleotides.
218. The composition of any of items 212 to 217, further including a first probe containing a fluorescent or other detectable label.
219. The composition of item 218, wherein the label of the first probe is a fluorescent label and the probe further includes a quencher that quenches the fluorescent label.
220. The composition of item 218 or 219, wherein the first probe is configured to hybridize to a first target subsequence that is complementary or identical to at least 10 contiguous nucleotides of the first target sequence, a DNA copy thereof, or their respective complements.
221. The composition of any of items 212-220, further including a second forward primer and a second reverse primer configured to amplify a second target sequence within a second target region of the SARS-CoV-2 genome.
222. The composition of item 221, wherein the second forward primer and the second reverse primer are configured to bind to different ends of the second target sequence or to a cDNA complement thereof.
223. The composition of items 221 or 222, wherein the nucleic acid sequence of the first target region and the second target region are different and are selected from the group consisting of: SEQ ID NO: 1, SEQ ID NO: 2, and SEQ ID NO: 3.
224. The composition of items 221-223, further including a third forward primer and a third reverse primer configured to amplify a third target sequence within a third target region of the SARS-CoV-2 genome.

225. The composition of item 224, wherein the third forward primer and the third reverse primer are configured to bind to different ends of the third target sequence or to a DNA copy or DNA complement thereof.
226. The composition of items 224 and 225, wherein the nucleic acid sequence of the first target region, the second target region and the third target region are different and are selected from the group consisting of: SEQ ID NO: 1, SEQ ID NO: 2, and SEQ ID NO: 3.
227. The composition of item 226, wherein the primer sequences specific for the first target sequence are selected from SEQ ID NOs: 248 and 487, or 211 and 501.
228. The composition of item 226 or 227, wherein the primer sequences specific for the second target sequence are selected from SEQ ID NOs: 5 and 441, or 100 and 337.
229. The composition of any of items 226-228, wherein the primer sequences specific for the third target sequence are selected from SEQ ID NOs: 4 and 320, or 34 and 423, or 160 and 468.
230. A composition useful as an amplification control in a reaction to detect SARS-CoV-2 viral nucleic acids in a sample, comprising a linear or circular nucleic acid molecule including, in any order, at least one target sequence derived from the N gene of SARS-CoV-2, at least one further target sequence derived from the S gene of SARS-CoV-2, and at least one target sequence derived from the orf1ab gene of SARS-CoV-2.
231. A kit for detecting SARS-CoV-2 viral nucleic acid in a sample, comprising a composition of any of items 202-230, or any combinations thereof.
232. The kit of item 231, further including a master mix.
233. The kit of item 232, wherein the master mix is TaqMan Fast Virus 1-Step Master Mix or TaqPath 1-Step RT-qPCR Master Mix, CG.
234. The kit of any of items 231-233, wherein at least one of the components is dried or freeze dried.
235. The kit of any of items 231-234, further including an array of qPCR assays, each qPCR assay situated in a different locus of the array.
236. The kit of item 235, wherein the different locus includes a well, channel, groove, cavity, site or feature on the surface of the array.
237. A method of detecting SARS-CoV-2 viral nucleic acid present in a sample, comprising:
   (c) providing a composition according to any of items 202-230;
   (d) forming a reaction volume by contacting the composition, in any order or combination, with a polymerase, nucleotides and a sample obtained from bodily tissue taken from an organism; and
   (e) forming one or more amplification products containing amplified coronaviral sequences in the reaction volume, wherein the forming includes subjecting the reaction volume to amplification conditions suitable to amplify target coronaviral sequences from coronaviral nucleic acid, wherein the coronaviral nucleic acid are present in the sample prior to amplification.
238. The method of item 237, further including detecting at least one of the amplification products during or after the forming step.
239. The method of item 238, further including diagnosing a coronaviral infection in the organism.
240. The method of items 237-239, wherein the organism is a human patient and the coronaviral nucleic acid is derived from SARS-CoV-2.
241. The method of items 237-240, wherein the forming includes amplifying at least three different coronaviral target sequences from the coronaviral nucleic acid.
242. The method of item 241, wherein the at least three different coronaviral target sequences include one target sequence derived from the N gene, one target sequence derived from the S gene, and one target sequence derived from the orf1ab gene.

SEQUENCE LISTING (2556 sequences)

SEQ ID NO: 1 - DNA, 2001 bp, Severe acute respiratory syndrome coronavirus 2
tgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctgg

SEQ ID NO: 2 - DNA, 2001 bp, Severe acute respiratory syndrome coronavirus 2
tgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtg

SEQ ID NO: 3 - DNA, 1284 bp, Severe acute respiratory syndrome coronavirus 2
tgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcaga

SEQ ID NO: 4 - DNA, 25 bp, Artificial Sequence
  Description of Artificial Sequence: Synthetic oligonucleotide
tccagcatgtcacaattcagaagta

SEQ ID NO: 5 - DNA, 25 bp, Artificial Sequence
  Description of Artificial Sequence: Synthetic oligonucleotide
gttggatggaaagtgagttcagagt

SEQ ID NO: 6 - DNA, 25 bp, Artificial Sequence
  Description of Artificial Sequence: Synthetic oligonucleotide
cgtagtcgcaacagttcaagaaatt

SEQ ID NO: 7 - DNA, 25 bp, Artificial Sequence
  Description of Artificial Sequence: Synthetic oligonucleotide
tgctgcagcttattatgtgggttat

SEQ ID NO: 8 - DNA, 24 bp, Artificial Sequence
  Description of Artificial Sequence: Synthetic oligonucleotide
tgtctctgggaccaatggtactaa

SEQ ID NO: 9 - DNA, 21 bp, Artificial Sequence
  Description of Artificial Sequence: Synthetic oligonucleotide
gggaacgtggttgacctacac

SEQ ID NO: 10 - DNA, 20 bp, Artificial Sequence
  Description of Artificial Sequence: Synthetic oligonucleotide
ctgtgcacttgaccctctct

SEQ ID NO: 11 - DNA, 24 bp, Artificial Sequence
  Description of Artificial Sequence: Synthetic oligonucleotide
gcagagacagaagaaacagcaaac

SEQ ID NO: 12 - DNA, 24 bp, Artificial Sequence
  Description of Artificial Sequence: Synthetic oligonucleotide
tccaatgttacttggttccatgct

SEQ ID NO: 13 - DNA, 21 bp, Artificial Sequence
  Description of Artificial Sequence: Synthetic oligonucleotide
gccaacaacaacaaggccaaa

SEQ ID NO: 14 - DNA, 23 bp, Artificial Sequence
  Description of Artificial Sequence: Synthetic oligonucleotide
gtgctagcgctaacataggttgt

SEQ ID NO: 15 - DNA, 23 bp, Artificial Sequence
  Description of Artificial Sequence: Synthetic oligonucleotide
caagcctcttctcgttcctcatc

SEQ ID NO: 16 - DNA, 23 bp, Artificial Sequence
  Description of Artificial Sequence: Synthetic oligonucleotide
aaattcaactccaggcagcagta

SEQ ID NO: 17 - DNA, 23 bp, Artificial Sequence
  Description of Artificial Sequence: Synthetic oligonucleotide
ccctcagattcaactggcagtaa

SEQ ID NO: 18 - DNA, 20 bp, Artificial Sequence
  Description of Artificial Sequence: Synthetic oligonucleotide
cttggttcaccgctctcact

SEQ ID NO: 19 - DNA, 21 bp, Artificial Sequence
  Description of Artificial Sequence: Synthetic oligonucleotide
cgcaatcctgctaacaatgct

SEQ ID NO: 20 - DNA, 22 bp, Artificial Sequence
  Description of Artificial Sequence: Synthetic oligonucleotide
cttcagcgttcttcggaatgtc

SEQ ID NO: 21 - DNA, 22 bp, Artificial Sequence
  Description of Artificial Sequence: Synthetic oligonucleotide
gttgcgtcaccaaatgaatgca

SEQ ID NO: 22 - DNA, 23 bp, Artificial Sequence
  Description of Artificial Sequence: Synthetic oligonucleotide
gagcatagtcttgccgaatacca

SEQ ID NO: 23 - DNA, 25 bp, Artificial Sequence
  Description of Artificial Sequence: Synthetic oligonucleotide
gctgcagcttattatgtgggttatc

SEQ ID NO: 24 - DNA, 25 bp, Artificial Sequence
  Description of Artificial Sequence: Synthetic oligonucleotide
cgaagacccagtccctacttattgt

SEQ ID NO: 25 - DNA, 21 bp, Artificial Sequence
  Description of Artificial Sequence: Synthetic oligonucleotide
gcagtcaagcctcttctcgtt

SEQ ID NO: 26 - DNA, 22 bp, Artificial Sequence
  Description of Artificial Sequence: Synthetic oligonucleotide
caagtgtgcctattgggttcca

SEQ ID NO: 27 - DNA, 25 bp, Artificial Sequence
  Description of Artificial Sequence: Synthetic oligonucleotide
cgtactgccactaaagcatacaatg

SEQ ID NO: 28 - DNA, 26 bp, Artificial Sequence
  Description of Artificial Sequence: Synthetic oligonucleotide
acgcctattaatttagtgcgtgatct

SEQ ID NO: 29 - DNA, 24 bp, Artificial Sequence
  Description of Artificial Sequence: Synthetic oligonucleotide
tgaaggaaaacagggtaatttcaa

SEQ ID NO: 30 - DNA, 25 bp, Artificial Sequence
  Description of Artificial Sequence: Synthetic oligonucleotide
cgtcaccaaatgaatgcaaccaaat

SEQ ID NO: 31 - DNA, 20 bp, Artificial Sequence
  Description of Artificial Sequence: Synthetic oligonucleotide
ggttcaccgctctcactcaa

SEQ ID NO: 32 - DNA, 25 bp, Artificial Sequence
  Description of Artificial Sequence: Synthetic oligonucleotide
tgttaacaactaaacgaacaatgtt

SEQ ID NO: 33 - DNA, 21 bp, Artificial Sequence
  Description of Artificial Sequence: Synthetic oligonucleotide
ttcgtggtggtgacggtaaaa

SEQ ID NO: 34 - DNA, 20 bp, Artificial Sequence
  Description of Artificial Sequence: Synthetic oligonucleotide
agaggctgctcgtgttgtac

SEQ ID NO: 35 - DNA, 24 bp, Artificial Sequence
  Description of Artificial Sequence: Synthetic oligonucleotide
ccctcagattcaactggcagtaac

SEQ ID NO: 36 - DNA, 17 bp, Artificial Sequence
  Description of Artificial Sequence: Synthetic oligonucleotide
gcagaggcggcagtcaa

SEQ ID NO: 37 - DNA, 24 bp, Artificial Sequence
  Description of Artificial Sequence: Synthetic oligonucleotide
gtccagaacaaacccaaggaaatt

SEQ ID NO: 38 - DNA, 22 bp, Artificial Sequence
  Description of Artificial Sequence: Synthetic oligonucleotide
caagcctcttctcgttcctcat

SEQ ID NO: 39 - DNA, 24 bp, Artificial Sequence
  Description of Artificial Sequence: Synthetic oligonucleotide
ttgacagattgaaccagcttgaga

SEQ ID NO: 40 - DNA, 20 bp, Artificial Sequence
  Description of Artificial Sequence: Synthetic oligonucleotide
ggttcaccgctctcactcaa

SEQ ID NO: 41 - DNA, 23 bp, Artificial Sequence
  Description of Artificial Sequence: Synthetic oligonucleotide
gggcgattttgttaaagccactt

SEQ ID NO: 42 - DNA, 22 bp, Artificial Sequence
  Description of Artificial Sequence: Synthetic oligonucleotide
ctgctgctgaggcttctaagaa

SEQ ID NO: 43 - DNA, 25 bp, Artificial Sequence
  Description of Artificial Sequence: Synthetic oligonucleotide
gccccaaggtttacccaataatact

SEQ ID NO: 44 - DNA, 22 bp, Artificial Sequence
  Description of Artificial Sequence: Synthetic oligonucleotide
gtctatccagttgcgtcaccaa

SEQ ID NO: 45 - DNA, 22 bp, Artificial Sequence
  Description of Artificial Sequence: Synthetic oligonucleotide
gcagacgggcgattttgttaaa

SEQ ID NO: 46 - DNA, 23 bp, Artificial Sequence
  Description of Artificial Sequence: Synthetic oligonucleotide
aactgagggagccttgaatacac

SEQ ID NO: 47 - DNA, 22 bp, Artificial Sequence
  Description of Artificial Sequence: Synthetic oligonucleotide
ttcgaagacccagtccctactt

SEQ ID NO: 48 - DNA, 22 bp, Artificial Sequence
  Description of Artificial Sequence: Synthetic oligonucleotide
tgctgtagactgtgcacttgac

SEQ ID NO: 49 - DNA, 22 bp, Artificial Sequence
  Description of Artificial Sequence: Synthetic oligonucleotide
tgcaatcgtgctacaacttcct

SEQ ID NO: 50 - DNA, 25 bp, Artificial Sequence
  Description of Artificial Sequence: Synthetic oligonucleotide
gttgccataacaagtgtgcctattg

SEQ ID NO: 51 - DNA, 20 bp, Artificial Sequence
  Description of Artificial Sequence: Synthetic oligonucleotide
gcagacgggcgattttgtta

SEQ ID NO: 52 - DNA, 21 bp, Artificial Sequence
  Description of Artificial Sequence: Synthetic oligonucleotide
tgctgcaatcgtgctacaact

SEQ ID NO: 53 - DNA, 22 bp, Artificial Sequence
  Description of Artificial Sequence: Synthetic oligonucleotide
ggctactaccgaagagctacca

SEQ ID NO: 54 - DNA, 23 bp, Artificial Sequence
  Description of Artificial Sequence: Synthetic oligonucleotide
ggacaaggcgttccaattaacac

SEQ ID NO: 55 - DNA, 29 bp, Artificial Sequence
  Description of Artificial Sequence: Synthetic oligonucleotide
gatccatttttgggtgtttattaccacaa

SEQ ID NO: 56 - DNA, 19 bp, Artificial Sequence
  Description of Artificial Sequence: Synthetic oligonucleotide
cgtcggccccaaggtttac

SEQ ID NO: 57 - DNA, 24 bp, Artificial Sequence
  Description of Artificial Sequence: Synthetic oligonucleotide
cttctcgttcctcatcacgtagtc

SEQ ID NO: 58 - DNA, 22 bp, Artificial Sequence
  Description of Artificial Sequence: Synthetic oligonucleotide
caacaacaaggccaaactgtca

SEQ ID NO: 59 - DNA, 25 bp, Artificial Sequence
  Description of Artificial Sequence: Synthetic oligonucleotide
agcttgagagcaaaatgtctggtaa

SEQ ID NO: 60 - DNA, 23 bp, Artificial Sequence
  Description of Artificial Sequence: Synthetic oligonucleotide
gcagagacagaagaaacagcaaa

SEQ ID NO: 61 - DNA, 25 bp, Artificial Sequence
  Description of Artificial Sequence: Synthetic oligonucleotide
gtccagatgaccaaattggctacta

SEQ ID NO: 62 - DNA, 22 bp, Artificial Sequence
  Description of Artificial Sequence: Synthetic oligonucleotide
tcacgtagtcgcaacagttcaa

SEQ ID NO: 63 - DNA, 22 bp, Artificial Sequence
  Description of Artificial Sequence: Synthetic oligonucleotide
gagggagccttgaatacaccaa

SEQ ID NO: 64 - DNA, 24 bp, Artificial Sequence
  Description of Artificial Sequence: Synthetic oligonucleotide
cagcaaactgtgactcttcttcct

SEQ ID NO: 65 - DNA, 25 bp, Artificial Sequence
  Description of Artificial Sequence: Synthetic oligonucleotide
acaaggccaaactgtcactaagaaa

SEQ ID NO: 66 - DNA, 25 bp, Artificial Sequence
  Description of Artificial Sequence: Synthetic oligonucleotide
ctcaattaccccctgcatacactaa

SEQ ID NO: 67 - DNA, 20 bp, Artificial Sequence
  Description of Artificial Sequence: Synthetic oligonucleotide
ccacgtgctagcgctaacat

SEQ ID NO: 68 - DNA, 25 bp, Artificial Sequence
  Description of Artificial Sequence: Synthetic oligonucleotide
ggagccttgaatacaccaaaagatc

SEQ ID NO: 69 - DNA, 19 bp, Artificial Sequence
  Description of Artificial Sequence: Synthetic oligonucleotide
gcagacgtggtccagaaca

SEQ ID NO: 70 - DNA, 25 bp, Artificial Sequence
  Description of Artificial Sequence: Synthetic oligonucleotide
aaaatgtctggtaaaggccaacaac

SEQ ID NO: 71 - DNA, 19 bp, Artificial Sequence
  Description of Artificial Sequence: Synthetic oligonucleotide
ggcgcgatcaaaacaacgt

SEQ ID NO: 72 - DNA, 25 bp, Artificial Sequence
  Description of Artificial Sequence: Synthetic oligonucleotide
ggaccaatggtactaagaggtttga

SEQ ID NO: 73 - DNA, 21 bp, Artificial Sequence
  Description of Artificial Sequence: Synthetic oligonucleotide
ggtcgcactattgcctttgga

SEQ ID NO: 74 - DNA, 24 bp, Artificial Sequence
  Description of Artificial Sequence: Synthetic oligonucleotide
ctggtgattcttcttcaggttgga

SEQ ID NO: 75 - DNA, 22 bp, Artificial Sequence
  Description of Artificial Sequence: Synthetic oligonucleotide
atcacgtagtcgcaacagttca

SEQ ID NO: 76 - DNA, 24 bp, Artificial Sequence
  Description of Artificial Sequence: Synthetic oligonucleotide
caacaaggccaaactgtcactaag

SEQ ID NO: 77 - DNA, 25 bp, Artificial Sequence
  Description of Artificial Sequence: Synthetic oligonucleotide
cctctctcagaaacaaagtgtacgt

SEQ ID NO: 78 - DNA, 19 bp, Artificial Sequence
  Description of Artificial Sequence: Synthetic oligonucleotide
cagcgcttcagcgttcttc

SEQ ID NO: 79 - DNA, 23 bp, Artificial Sequence
  Description of Artificial Sequence: Synthetic oligonucleotide
gtttggtggaccctcagattcaa

SEQ ID NO: 80 - DNA, 24 bp, Artificial Sequence
  Description of Artificial Sequence: Synthetic oligonucleotide
ttggaggctgtgtgttctcttatg

SEQ ID NO: 81 - DNA, 21 bp, Artificial Sequence
  Description of Artificial Sequence: Synthetic oligonucleotide
ccccaaaatcagcgaaatgca

SEQ ID NO: 82 - DNA, 21 bp, Artificial Sequence
  Description of Artificial Sequence: Synthetic oligonucleotide
cgtgatctccctcagggtttt

SEQ ID NO: 83 - DNA, 25 bp, Artificial Sequence
  Description of Artificial Sequence: Synthetic oligonucleotide
gactaaagaaggtgccactacttgt

SEQ ID NO: 84 - DNA, 23 bp, Artificial Sequence
  Description of Artificial Sequence: Synthetic oligonucleotide
ctacacaggtgccatcaaattgg

SEQ ID NO: 85 - DNA, 23 bp, Artificial Sequence
  Description of Artificial Sequence: Synthetic oligonucleotide
ggcatcatatgggttgcaactga

SEQ ID NO: 86 - DNA, 21 bp, Artificial Sequence
  Description of Artificial Sequence: Synthetic oligonucleotide
agacgtggtccagaacaaacc

SEQ ID NO: 87 - DNA, 19 bp, Artificial Sequence
  Description of Artificial Sequence: Synthetic oligonucleotide
tggccgcaaattgcacaat

SEQ ID NO: 88 - DNA, 21 bp, Artificial Sequence
  Description of Artificial Sequence: Synthetic oligonucleotide
aaatctgctgctgaggcttct

SEQ ID NO: 89 - DNA, 26 bp, Artificial Sequence
  Description of Artificial Sequence: Synthetic oligonucleotide
ggctttagaaccattggtagatttgc

SEQ ID NO: 90 - DNA, 24 bp, Artificial Sequence
  Description of Artificial Sequence: Synthetic oligonucleotide
caaaatgtctggtaaaggccaaca

SEQ ID NO: 91 - DNA, 25 bp, Artificial Sequence
  Description of Artificial Sequence: Synthetic oligonucleotide
caaaatgtctggtaaaggccaacaa

SEQ ID NO: 92 - DNA, 20 bp, Artificial Sequence
  Description of Artificial Sequence: Synthetic oligonucleotide
ctcttgctttgctgctgctt

SEQ ID NO: 93 - DNA, 19 bp, Artificial Sequence
  Description of Artificial Sequence: Synthetic oligonucleotide
cgggaacgtggttgaccta

SEQ ID NO: 94 - DNA, 25 bp, Artificial Sequence
  Description of Artificial Sequence: Synthetic oligonucleotide
gttacttaccccaaaatgctgttgt

SEQ ID NO: 95 - DNA, 24 bp, Artificial Sequence
  Description of Artificial Sequence: Synthetic oligonucleotide
aacaccaatagcagtccagatgac

SEQ ID NO: 96 - DNA, 25 bp, Artificial Sequence
  Description of Artificial Sequence: Synthetic oligonucleotide
ggctgtgtgttctcttatgttggtt

SEQ ID NO: 97 - DNA, 23 bp, Artificial Sequence
  Description of Artificial Sequence: Synthetic oligonucleotide
agattgaaccagcttgagagcaa

SEQ ID NO: 98 - DNA, 26 bp, Artificial Sequence
  Description of Artificial Sequence: Synthetic oligonucleotide
caacaaaagttggatggaaagtgagt

SEQ ID NO: 99 - DNA, 22 bp, Artificial Sequence
  Description of Artificial Sequence: Synthetic oligonucleotide
tcatcacgtagtcgcaacagtt

SEQ ID NO: 100 - DNA, 27 bp, Artificial Sequence
  Description of Artificial Sequence: Synthetic oligonucleotide
aggacttgttcttacctttcttttcca

SEQ ID NO: 101 - DNA, 25 bp, Artificial Sequence
  Description of Artificial Sequence: Synthetic oligonucleotide
agagctatgaattgcagacaccttt

SEQ ID NO: 102 - DNA, 21 bp, Artificial Sequence
  Description of Artificial Sequence: Synthetic oligonucleotide
ggtgatgctgctcttgctttg

SEQ ID NO: 103 - DNA, 22 bp, Artificial Sequence
  Description of Artificial Sequence: Synthetic oligonucleotide
ggtggaccctcagattcaactg

SEQ ID NO: 104 - DNA, 18 bp, Artificial Sequence
  Description of Artificial Sequence: Synthetic oligonucleotide
gcggcagtcaagcctctt

SEQ ID NO: 105 - DNA, 24 bp, Artificial Sequence
  Description of Artificial Sequence: Synthetic oligonucleotide
aacaaggccaaactgtcactaaga

SEQ ID NO: 106 - DNA, 30 bp, Artificial Sequence
  Description of Artificial Sequence: Synthetic oligonucleotide
tgagaagtctaacataataagaggctggat

SEQ ID NO: 107 - DNA, 22 bp, Artificial Sequence
  Description of Artificial Sequence: Synthetic oligonucleotide
cgtcaccaaatgaatgcaacca

SEQ ID NO: 108 - DNA, 25 bp, Artificial Sequence
  Description of Artificial Sequence: Synthetic oligonucleotide
gaagtaggacctgagcatagtcttg

SEQ ID NO: 109 - DNA, 19 bp, Artificial Sequence
  Description of Artificial Sequence: Synthetic oligonucleotide
accccgcattacgtttggt

SEQ ID NO: 110 - DNA, 25 bp, Artificial Sequence
  Description of Artificial Sequence: Synthetic oligonucleotide
ggtggtgacggtaaaatgaaagatc

SEQ ID NO: 111 - DNA, 26 bp, Artificial Sequence
  Description of Artificial Sequence: Synthetic oligonucleotide
gcaaagaaatttgacaccttcaatgg

SEQ ID NO: 112 - DNA, 23 bp, Artificial Sequence
  Description of Artificial Sequence: Synthetic oligonucleotide
gcgaattttgtggcactgagaat

SEQ ID NO: 113 - DNA, 25 bp, Artificial Sequence
  Description of Artificial Sequence: Synthetic oligonucleotide
ggcttgaaaaccattcttcgtaagg

SEQ ID NO: 114 - DNA, 23 bp, Artificial Sequence
  Description of Artificial Sequence: Synthetic oligonucleotide
aatctgctgctgaggcttctaag

SEQ ID NO: 115 - DNA, 24 bp, Artificial Sequence
  Description of Artificial Sequence: Synthetic oligonucleotide
gggagccttgaatacaccaaaaga

SEQ ID NO: 116 - DNA, 24 bp, Artificial Sequence
  Description of Artificial Sequence: Synthetic oligonucleotide
caatcgtgctacaacttcctcaag

SEQ ID NO: 117 - DNA, 25 bp, Artificial Sequence
  Description of Artificial Sequence: Synthetic oligonucleotide
accaaatgtgcctttcaactctcat

SEQ ID NO: 118 - DNA, 18 bp, Artificial Sequence
  Description of Artificial Sequence: Synthetic oligonucleotide
tggcagacgggcgatttt

SEQ ID NO: 119 - DNA, 21 bp, Artificial Sequence
  Description of Artificial Sequence: Synthetic oligonucleotide
ggttcaccgctctcactcaac

SEQ ID NO: 120 - DNA, 22 bp, Artificial Sequence
  Description of Artificial Sequence: Synthetic oligonucleotide
ttcgtggtggtgacggtaaaat

SEQ ID NO: 121 - DNA, 26 bp, Artificial Sequence
  Description of Artificial Sequence: Synthetic oligonucleotide
aacagagttgttatttctagtgatgt

SEQ ID NO: 122 - DNA, 23 bp, Artificial Sequence
  Description of Artificial Sequence: Synthetic oligonucleotide
cattcccaccaacagagcctaaa

SEQ ID NO: 123 - DNA, 23 bp, Artificial Sequence
  Description of Artificial Sequence: Synthetic oligonucleotide
caatcctgctaacaatgctgcaa

SEQ ID NO: 124 - DNA, 22 bp, Artificial Sequence
  Description of Artificial Sequence: Synthetic oligonucleotide
agacgggcgattttgttaaagc

SEQ ID NO: 125 - DNA, 22 bp, Artificial Sequence
  Description of Artificial Sequence: Synthetic oligonucleotide
gcacttgaccctctctcagaaa

SEQ ID NO: 126 - DNA, 25 bp, Artificial Sequence
  Description of Artificial Sequence: Synthetic oligonucleotide
caaggcgttccaattaacaccaata

SEQ ID NO: 127 - DNA, 19 bp, Artificial Sequence
  Description of Artificial Sequence: Synthetic oligonucleotide
ggcagacgtggtccagaac

SEQ ID NO: 128 - DNA, 25 bp, Artificial Sequence
  Description of Artificial Sequence: Synthetic oligonucleotide
ggaccttgaaggaaaacagggtaat

SEQ ID NO: 129 - DNA, 19 bp, Artificial Sequence
  Description of Artificial Sequence: Synthetic oligonucleotide
agggtggtcgcactattgc

SEQ ID NO: 130 - DNA, 25 bp, Artificial Sequence
  Description of Artificial Sequence: Synthetic oligonucleotide
ctgctgcagatttggatgatttctc

SEQ ID NO: 131 - DNA, 27 bp, Artificial Sequence
  Description of Artificial Sequence: Synthetic oligonucleotide
acaaaagttggatggaaagtgagttca

SEQ ID NO: 132 - DNA, 23 bp, Artificial Sequence
  Description of Artificial Sequence: Synthetic oligonucleotide
acatgtctctgggaccaatggta

SEQ ID NO: 133 - DNA, 25 bp, Artificial Sequence
  Description of Artificial Sequence: Synthetic oligonucleotide
ctcagccttttcttatggaccttga

SEQ ID NO: 134 - DNA, 18 bp, Artificial Sequence
  Description of Artificial Sequence: Synthetic oligonucleotide
ccagcgcttcagcgttct

SEQ ID NO: 135 - DNA, 24 bp, Artificial Sequence
  Description of Artificial Sequence: Synthetic oligonucleotide
tcaaggaacaacattgccaaaagg

SEQ ID NO: 136 - DNA, 25 bp, Artificial Sequence
  Description of Artificial Sequence: Synthetic oligonucleotide
ccaaatgtgcctttcaactctcatg

SEQ ID NO: 137 - DNA, 23 bp, Artificial Sequence
  Description of Artificial Sequence: Synthetic oligonucleotide
gcagagacagaagaaacagcaaa

SEQ ID NO: 138 - DNA, 24 bp, Artificial Sequence
  Description of Artificial Sequence: Synthetic oligonucleotide
agcttgagagcaaaatgtctggta

SEQ ID NO: 139 - DNA, 22 bp, Artificial Sequence
  Description of Artificial Sequence: Synthetic oligonucleotide
ccgaagagctaccagacgaatt

SEQ ID NO: 140 - DNA, 24 bp, Artificial Sequence
  Description of Artificial Sequence: Synthetic oligonucleotide
gttgccataacaagtgtgcctatt

SEQ ID NO: 141 - DNA, 19 bp, Artificial Sequence
  Description of Artificial Sequence: Synthetic oligonucleotide
ggttcaccgctctcactca

SEQ ID NO: 142 - DNA, 20 bp, Artificial Sequence
  Description of Artificial Sequence: Synthetic oligonucleotide
gatgctgctcttgctttgct

SEQ ID NO: 143 - DNA, 21 bp, Artificial Sequence
  Description of Artificial Sequence: Synthetic oligonucleotide
ggtggtcgcactattgccttt

SEQ ID NO: 144 - DNA, 22 bp, Artificial Sequence
  Description of Artificial Sequence: Synthetic oligonucleotide
tgctgcttgacagattgaacca

SEQ ID NO: 145 - DNA, 24 bp, Artificial Sequence
  Description of Artificial Sequence: Synthetic oligonucleotide
gcgttccaattaacaccaatagca

SEQ ID NO: 146 - DNA, 20 bp, Artificial Sequence
  Description of Artificial Sequence: Synthetic oligonucleotide
gggaacgtggttgacctaca

SEQ ID NO: 147 - DNA, 22 bp, Artificial Sequence
  Description of Artificial Sequence: Synthetic oligonucleotide
cttgcgaattttgtggcactga

SEQ ID NO: 148 - DNA, 23 bp, Artificial Sequence
  Description of Artificial Sequence: Synthetic oligonucleotide
tggcagtaaccagaatggagaac

SEQ ID NO: 149 - DNA, 23 bp, Artificial Sequence
  Description of Artificial Sequence: Synthetic oligonucleotide
tcactcaacatggcaaggaagac

SEQ ID NO: 150 - DNA, 24 bp, Artificial Sequence
  Description of Artificial Sequence: Synthetic oligonucleotide
ggccccaaggtttacccaataata

SEQ ID NO: 151 - DNA, 24 bp, Artificial Sequence
  Description of Artificial Sequence: Synthetic oligonucleotide
cacgtggtgtttattaccctgaca

SEQ ID NO: 152 - DNA, 26 bp, Artificial Sequence
  Description of Artificial Sequence: Synthetic oligonucleotide
ggctttatgggtagaattcgatctgt

SEQ ID NO: 153 - DNA, 21 bp, Artificial Sequence
  Description of Artificial Sequence: Synthetic oligonucleotide
cctattgggttccacgtgcta

SEQ ID NO: 154 - DNA, 25 bp, Artificial Sequence
  Description of Artificial Sequence: Synthetic oligonucleotide
catacaaaacattcccaccaacaga

SEQ ID NO: 155 - DNA, 17 bp, Artificial Sequence
  Description of Artificial Sequence: Synthetic oligonucleotide
tgcaccccgcattacgt

SEQ ID NO: 156 - DNA, 23 bp, Artificial Sequence
  Description of Artificial Sequence: Synthetic oligonucleotide
gcaaccaaatgtgcctttcaact

SEQ ID NO: 157 - DNA, 18 bp, Artificial Sequence
  Description of Artificial Sequence: Synthetic oligonucleotide
ggaactgggccagaagct

SEQ ID NO: 158 - DNA, 21 bp, Artificial Sequence
  Description of Artificial Sequence: Synthetic oligonucleotide
ggtgatgctgctcttgctttg

SEQ ID NO: 159 - DNA, 19 bp, Artificial Sequence
  Description of Artificial Sequence: Synthetic oligonucleotide
ttggccgcaaattgcacaa

SEQ ID NO: 160 - DNA, 25 bp, Artificial Sequence
  Description of Artificial Sequence: Synthetic oligonucleotide
tgcctggaatattggtgaacagaaa

SEQ ID NO: 161 - DNA, 24 bp, Artificial Sequence
  Description of Artificial Sequence: Synthetic oligonucleotide
aactcaattaccccctgcatacac

SEQ ID NO: 162 - DNA, 21 bp, Artificial Sequence
  Description of Artificial Sequence: Synthetic oligonucleotide
gctgcaatcgtgctacaactt

SEQ ID NO: 163 - DNA, 25 bp, Artificial Sequence
  Description of Artificial Sequence: Synthetic oligonucleotide
caaaatgtctggtaaaggccaacaa

SEQ ID NO: 164 - DNA, 24 bp, Artificial Sequence
  Description of Artificial Sequence: Synthetic oligonucleotide
ccaatagcagtccagatgaccaaa

SEQ ID NO: 165 - DNA, 26 bp, Artificial Sequence
  Description of Artificial Sequence: Synthetic oligonucleotide
cccctgcatacactaattctttcaca

SEQ ID NO: 166 - DNA, 19 bp, Artificial Sequence
  Description of Artificial Sequence: Synthetic oligonucleotide
ccttcgggaacgtggttga

SEQ ID NO: 167 - DNA, 22 bp, Artificial Sequence
  Description of Artificial Sequence: Synthetic oligonucleotide
attcaactccaggcagcagtag

SEQ ID NO: 168 - DNA, 18 bp, Artificial Sequence
  Description of Artificial Sequence: Synthetic oligonucleotide
gggcgcgatcaaaacaac

SEQ ID NO: 169 - DNA, 19 bp, Artificial Sequence
  Description of Artificial Sequence: Synthetic oligonucleotide
cgcattggcatggaagtca

SEQ ID NO: 170 - DNA, 22 bp, Artificial Sequence
  Description of Artificial Sequence: Synthetic oligonucleotide
cattcccaccaacagagcctaa

SEQ ID NO: 171 - DNA, 23 bp, Artificial Sequence
  Description of Artificial Sequence: Synthetic oligonucleotide
gaaatctgctgctgaggcttcta

SEQ ID NO: 172 - DNA, 21 bp, Artificial Sequence
  Description of Artificial Sequence: Synthetic oligonucleotide
ggtccagaacaaacccaagga

SEQ ID NO: 173 - DNA, 21 bp, Artificial Sequence
  Description of Artificial Sequence: Synthetic oligonucleotide
ttggcatggaagtcacacctt

SEQ ID NO: 174 - DNA, 23 bp, Artificial Sequence
  Description of Artificial Sequence: Synthetic oligonucleotide
cgtcaccaaatgaatgcaaccaa

SEQ ID NO: 175 - DNA, 23 bp, Artificial Sequence
  Description of Artificial Sequence: Synthetic oligonucleotide
ctcaattaccccctgcatacact

SEQ ID NO: 176 - DNA, 21 bp, Artificial Sequence
  Description of Artificial Sequence: Synthetic oligonucleotide
cgtggtggtgacggtaaaatg

SEQ ID NO: 177 - DNA, 22 bp, Artificial Sequence
  Description of Artificial Sequence: Synthetic oligonucleotide
ctggacttccctatggtgctaa

SEQ ID NO: 178 - DNA, 22 bp, Artificial Sequence
  Description of Artificial Sequence: Synthetic oligonucleotide
accgcagagacagaagaaacag

SEQ ID NO: 179 - DNA, 23 bp, Artificial Sequence
  Description of Artificial Sequence: Synthetic oligonucleotide
gcacttgaccctctctcagaaac

SEQ ID NO: 180 - DNA, 23 bp, Artificial Sequence
  Description of Artificial Sequence: Synthetic oligonucleotide
cacttgaccctctctcagaaaca

SEQ ID NO: 181 - DNA, 21 bp, Artificial Sequence
  Description of Artificial Sequence: Synthetic oligonucleotide
cttcagcgttcttcggaatgt

SEQ ID NO: 182 - DNA, 17 bp, Artificial Sequence
  Description of Artificial Sequence: Synthetic oligonucleotide
tggcagacgggcgattt

SEQ ID NO: 183 - DNA, 24 bp, Artificial Sequence
  Description of Artificial Sequence: Synthetic oligonucleotide
tgattacaaacattggccgcaaat

SEQ ID NO: 184 - DNA, 24 bp, Artificial Sequence
  Description of Artificial Sequence: Synthetic oligonucleotide
tctggcttgaaaaccattcttcgt

SEQ ID NO: 185 - DNA, 25 bp, Artificial Sequence
  Description of Artificial Sequence: Synthetic oligonucleotide
ccccctgcatacactaattctttca

SEQ ID NO: 186 - DNA, 26 bp, Artificial Sequence
  Description of Artificial Sequence: Synthetic oligonucleotide
cggctttagaaccattggtagatttg

SEQ ID NO: 187 - DNA, 20 bp, Artificial Sequence
  Description of Artificial Sequence: Synthetic oligonucleotide
ctcaagccttaccgcagaga

SEQ ID NO: 188 - DNA, 22 bp, Artificial Sequence
  Description of Artificial Sequence: Synthetic oligonucleotide
gcagtccagatgaccaaattgg

SEQ ID NO: 189 - DNA, 29 bp, Artificial Sequence
  Description of Artificial Sequence: Synthetic oligonucleotide
gaagttatttgactcctggtgattcttct

SEQ ID NO: 190 - DNA, 23 bp, Artificial Sequence
  Description of Artificial Sequence: Synthetic oligonucleotide
tgattacaaacattggccgcaaa

SEQ ID NO: 191 - DNA, 25 bp, Artificial Sequence
  Description of Artificial Sequence: Synthetic oligonucleotide
gaccttaaattccctcgaggacaag

SEQ ID NO: 192 - DNA, 22 bp, Artificial Sequence
  Description of Artificial Sequence: Synthetic oligonucleotide
tggtggaccctcagattcaact

SEQ ID NO: 193 - DNA, 25 bp, Artificial Sequence
  Description of Artificial Sequence: Synthetic oligonucleotide
gggagccttgaatacaccaaaagat

SEQ ID NO: 194 - DNA, 18 bp, Artificial Sequence
  Description of Artificial Sequence: Synthetic oligonucleotide
gcacccgcaatcctgcta

SEQ ID NO: 195 - DNA, 21 bp, Artificial Sequence
  Description of Artificial Sequence: Synthetic oligonucleotide
aaatctgctgctgaggcttct

SEQ ID NO: 196 - DNA, 25 bp, Artificial Sequence
  Description of Artificial Sequence: Synthetic oligonucleotide
ccaggaactaatcagacaaggaact

SEQ ID NO: 197 - DNA, 17 bp, Artificial Sequence
  Description of Artificial Sequence: Synthetic oligonucleotide
ttggcacccgcaatcct

SEQ ID NO: 198 - DNA, 24 bp, Artificial Sequence
  Description of Artificial Sequence: Synthetic oligonucleotide
ggtccagaacaaacccaaggaaat

SEQ ID NO: 199 - DNA, 21 bp, Artificial Sequence
  Description of Artificial Sequence: Synthetic oligonucleotide
gtcaagcctcttctcgttcct

SEQ ID NO: 200 - DNA, 20 bp, Artificial Sequence
  Description of Artificial Sequence: Synthetic oligonucleotide
gcagacgtggtccagaacaa

SEQ ID NO: 201 - DNA, 24 bp, Artificial Sequence
  Description of Artificial Sequence: Synthetic oligonucleotide
tgggaccaatggtactaagaggtt

SEQ ID NO: 202 - DNA, 25 bp, Artificial Sequence
  Description of Artificial Sequence: Synthetic oligonucleotide
aacaacattgccaaaaggcttctac

SEQ ID NO: 203 - DNA, 21 bp, Artificial Sequence
  Description of Artificial Sequence: Synthetic oligonucleotide
ccgaagagctaccagacgaat

SEQ ID NO: 204 - DNA, 23 bp, Artificial Sequence
  Description of Artificial Sequence: Synthetic oligonucleotide
cgtcaccaaatgaatgcaaccaa

SEQ ID NO: 205 - DNA, 23 bp, Artificial Sequence
  Description of Artificial Sequence: Synthetic oligonucleotide
ctggtgctgcagcttattatgtg

SEQ ID NO: 206 - DNA, 20 bp, Artificial Sequence
  Description of Artificial Sequence: Synthetic oligonucleotide
cttgctttgctgctgcttga

SEQ ID NO: 207 - DNA, 23 bp, Artificial Sequence
  Description of Artificial Sequence: Synthetic oligonucleotide
acacaggtgccatcaaattggat

SEQ ID NO: 208 - DNA, 21 bp, Artificial Sequence
  Description of Artificial Sequence: Synthetic oligonucleotide
catgtctctgggaccaatggt

SEQ ID NO: 209 - DNA, 22 bp, Artificial Sequence
  Description of Artificial Sequence: Synthetic oligonucleotide
ccctcagattcaactggcagta

SEQ ID NO: 210 - DNA, 23 bp, Artificial Sequence
  Description of Artificial Sequence: Synthetic oligonucleotide
gaaccagcttgagagcaaaatgt

SEQ ID NO: 211 - DNA, 17 bp, Artificial Sequence
  Description of Artificial Sequence: Synthetic oligonucleotide
gcaatggcggtgatgct

SEQ ID NO: 212 - DNA, 23 bp, Artificial Sequence
  Description of Artificial Sequence: Synthetic oligonucleotide
ttcttcctgctgcagatttggat

SEQ ID NO: 213 - DNA, 25 bp, Artificial Sequence
  Description of Artificial Sequence: Synthetic oligonucleotide
gaacaacattgccaaaaggcttcta

SEQ ID NO: 214 - DNA, 27 bp, Artificial Sequence
  Description of Artificial Sequence: Synthetic oligonucleotide
caactcaggacttgttcttacctttct

SEQ ID NO: 215 - DNA, 24 bp, Artificial Sequence
  Description of Artificial Sequence: Synthetic oligonucleotide
gggaatgtccaaattttgtatttc

SEQ ID NO: 216 - DNA, 22 bp, Artificial Sequence
  Description of Artificial Sequence: Synthetic oligonucleotide
gctgctgcttgacagattgaac

SEQ ID NO: 217 - DNA, 25 bp, Artificial Sequence
  Description of Artificial Sequence: Synthetic oligonucleotide
ttgaccctctctcagaaacaaagtg

SEQ ID NO: 218 - DNA, 23 bp, Artificial Sequence
  Description of Artificial Sequence: Synthetic oligonucleotide
gctgatgaaactcaagccttacc

SEQ ID NO: 219 - DNA, 25 bp, Artificial Sequence
  Description of Artificial Sequence: Synthetic oligonucleotide
ctctcagccttttcttatggacctt

SEQ ID NO: 220 - DNA, 28 bp, Artificial Sequence
  Description of Artificial Sequence: Synthetic oligonucleotide
gaggctggatttttggtactactttaga

SEQ ID NO: 221 - DNA, 23 bp, Artificial Sequence
  Description of Artificial Sequence: Synthetic oligonucleotide
agatgctgtagactgtgcacttg

SEQ ID NO: 222 - DNA, 19 bp, Artificial Sequence
  Description of Artificial Sequence: Synthetic oligonucleotide
gctttgctgctgcttgaca

SEQ ID NO: 223 - DNA, 28 bp, Artificial Sequence
  Description of Artificial Sequence: Synthetic oligonucleotide
cacttttgaatatgtctctcagcctttt

SEQ ID NO: 224 - DNA, 23 bp, Artificial Sequence
  Description of Artificial Sequence: Synthetic oligonucleotide
tgcaaccaaatgtgcctttcaac

SEQ ID NO: 225 - DNA, 20 bp, Artificial Sequence
  Description of Artificial Sequence: Synthetic oligonucleotide
gctagaatggctggcaatgg

SEQ ID NO: 226 - DNA, 24 bp, Artificial Sequence
  Description of Artificial Sequence: Synthetic oligonucleotide
acgtggtgtttattaccctgacaa

SEQ ID NO: 227 - DNA, 23 bp, Artificial Sequence
  Description of Artificial Sequence: Synthetic oligonucleotide
attcccaccaacagagcctaaaa

SEQ ID NO: 228 - DNA, 26 bp, Artificial Sequence
  Description of Artificial Sequence: Synthetic oligonucleotide
cttgatggctttatgggtagaattcg

SEQ ID NO: 229 - DNA, 25 bp, Artificial Sequence
  Description of Artificial Sequence: Synthetic oligonucleotide
cgtggtgtttattaccctgacaaag

SEQ ID NO: 230 - DNA, 24 bp, Artificial Sequence
  Description of Artificial Sequence: Synthetic oligonucleotide
ctgctgcagatttggatgatttct

SEQ ID NO: 231 - DNA, 21 bp, Artificial Sequence
  Description of Artificial Sequence: Synthetic oligonucleotide
cccgcaatcctgctaacaatg

SEQ ID NO: 232 - DNA, 24 bp, Artificial Sequence
  Description of Artificial Sequence: Synthetic oligonucleotide
gctaacaaagacggcatcatatgg

SEQ ID NO: 233 - DNA, 20 bp, Artificial Sequence
  Description of Artificial Sequence: Synthetic oligonucleotide
acggcatcatatgggttgca

SEQ ID NO: 234 - DNA, 21 bp, Artificial Sequence
  Description of Artificial Sequence: Synthetic oligonucleotide
tcaccgctctcactcaacatg

SEQ ID NO: 235 - DNA, 23 bp, Artificial Sequence
  Description of Artificial Sequence: Synthetic oligonucleotide
actcttcttcctgctgcagattt

SEQ ID NO: 236 - DNA, 23 bp, Artificial Sequence
  Description of Artificial Sequence: Synthetic oligonucleotide
ctggtaaaggccaacaacaacaa

SEQ ID NO: 237 - DNA, 25 bp, Artificial Sequence
  Description of Artificial Sequence: Synthetic oligonucleotide
cagagacagaagaaacagcaaactg

SEQ ID NO: 238 - DNA, 19 bp, Artificial Sequence
  Description of Artificial Sequence: Synthetic oligonucleotide
ttccacgtgctagcgctaa

SEQ ID NO: 239 - DNA, 18 bp, Artificial Sequence
  Description of Artificial Sequence: Synthetic oligonucleotide
ggcagacgtggtccagaa

SEQ ID NO: 240 - DNA, 19 bp, Artificial Sequence
  Description of Artificial Sequence: Synthetic oligonucleotide
gcacccgcaatcctgctaa

SEQ ID NO: 241 - DNA, 25 bp, Artificial Sequence
  Description of Artificial Sequence: Synthetic oligonucleotide
acttccctatggtgctaacaaagac

SEQ ID NO: 242 - DNA, 23 bp, Artificial Sequence
  Description of Artificial Sequence: Synthetic oligonucleotide
ccttaccgcagagacagaagaaa

SEQ ID NO: 243 - DNA, 25 bp, Artificial Sequence
  Description of Artificial Sequence: Synthetic oligonucleotide
gttaaagccacttgcgaattttgtg

SEQ ID NO: 244 - DNA, 22 bp, Artificial Sequence
  Description of Artificial Sequence: Synthetic oligonucleotide
acaacaaggccaaactgtcact

SEQ ID NO: 245 - DNA, 25 bp, Artificial Sequence
  Description of Artificial Sequence: Synthetic oligonucleotide
tgaaaagagctatgaattgcagaca

SEQ ID NO: 246 - DNA, 21 bp, Artificial Sequence
  Description of Artificial Sequence: Synthetic oligonucleotide
ccgcaatcctgctaacaatgc

SEQ ID NO: 247 - DNA, 23 bp, Artificial Sequence
  Description of Artificial Sequence: Synthetic oligonucleotide
aatgcaaccaaatgtgcctttca

SEQ ID NO: 248 - DNA, 24 bp, Artificial Sequence
  Description of Artificial Sequence: Synthetic oligonucleotide
ctcagattcaactggcagtaacca

SEQ ID NO: 249 - DNA, 24 bp, Artificial Sequence
  Description of Artificial Sequence: Synthetic oligonucleotide
tgctgcagcttattatgtgggtta

SEQ ID NO: 250 - DNA, 24 bp, Artificial Sequence
  Description of Artificial Sequence: Synthetic oligonucleotide
accaaatgtgcctttcaactctca

SEQ ID NO: 251 - DNA, 20 bp, Artificial Sequence
  Description of Artificial Sequence: Synthetic oligonucleotide
cgtaagggtggtcgcactat

SEQ ID NO: 252 - DNA, 26 bp, Artificial Sequence
  Description of Artificial Sequence: Synthetic oligonucleotide
aaaatgtgtgagctttcatgaagcat

SEQ ID NO: 253 - DNA, 24 bp, Artificial Sequence
  Description of Artificial Sequence: Synthetic oligonucleotide
ggaatggctaaagacaagaccaat

SEQ ID NO: 254 - DNA, 30 bp, Artificial Sequence
  Description of Artificial Sequence: Synthetic oligonucleotide
caagcttaacaactgaaattcaaatcaaca

SEQ ID NO: 255 - DNA, 24 bp, Artificial Sequence
  Description of Artificial Sequence: Synthetic oligonucleotide
gggcaaatatggaaacatacgtga

SEQ ID NO: 256 - DNA, 18 bp, Artificial Sequence
  Description of Artificial Sequence: Synthetic oligonucleotide
tgtcgccccaagcaactt

SEQ ID NO: 257 - DNA, 27 bp, Artificial Sequence
  Description of Artificial Sequence: Synthetic oligonucleotide
aaaatgtgtgagctttcatgaagcatt

SEQ ID NO: 258-266 - skipped (9 entries)

SEQ ID NO: 267 - DNA, 19 bp, Artificial Sequence
  Description of Artificial Sequence: Synthetic oligonucleotide
gcgaccacccttacgaaga

SEQ ID NO: 268 - DNA, 23 bp, Artificial Sequence
  Description of Artificial Sequence: Synthetic oligonucleotide
ccaatttgatggcacctgtgtag

SEQ ID NO: 269 - DNA, 30 bp, Artificial Sequence
  Description of Artificial Sequence: Synthetic oligonucleotide
aataaccatcaatattcttaaacacaaatt

SEQ ID NO: 270 - DNA, 26 bp, Artificial Sequence
  Description of Artificial Sequence: Synthetic oligonucleotide
aattctacccataaagccatcaagct

SEQ ID NO: 271 - DNA, 22 bp, Artificial Sequence
  Description of Artificial Sequence: Synthetic oligonucleotide
cgtctggtagctcttcggtagt

SEQ ID NO: 272 - DNA, 20 bp, Artificial Sequence
  Description of Artificial Sequence: Synthetic oligonucleotide
aagcagcagcaaagcaagag

SEQ ID NO: 273 - DNA, 25 bp, Artificial Sequence
  Description of Artificial Sequence: Synthetic oligonucleotide
attgtatgctttagtggcagtacgt

SEQ ID NO: 274 - DNA, 17 bp, Artificial Sequence
  Description of Artificial Sequence: Synthetic oligonucleotide
gggccgacgttgttttg

SEQ ID NO: 275 - DNA, 27 bp, Artificial Sequence
  Description of Artificial Sequence: Synthetic oligonucleotide
taaagttagaagtttgatagattcctt

SEQ ID NO: 276 - DNA, 25 bp, Artificial Sequence
  Description of Artificial Sequence: Synthetic oligonucleotide
gcttgagtttcatcagccttcttct

SEQ ID NO: 277 - DNA, 24 bp, Artificial Sequence
  Description of Artificial Sequence: Synthetic oligonucleotide
acccaataggcacacttgttatgg

SEQ ID NO: 278 - DNA, 19 bp, Artificial Sequence
  Description of Artificial Sequence: Synthetic oligonucleotide
acgtctgccgaaagcttgt

SEQ ID NO: 279 - DNA, 20 bp, Artificial Sequence
  Description of Artificial Sequence: Synthetic oligonucleotide
ggctctgttggtgggaatgt

SEQ ID NO: 280 - DNA, 21 bp, Artificial Sequence
  Description of Artificial Sequence: Synthetic oligonucleotide
agggactgggtcttcgaatct

SEQ ID NO: 281 - DNA, 22 bp, Artificial Sequence
  Description of Artificial Sequence: Synthetic oligonucleotide
gcacacttgttatggcaaccaa

SEQ ID NO: 282 - DNA, 25 bp, Artificial Sequence
  Description of Artificial Sequence: Synthetic oligonucleotide
caagtagtggcaccttctttagtca

SEQ ID NO: 283 - DNA, 26 bp, Artificial Sequence
  Description of Artificial Sequence: Synthetic oligonucleotide
ggtaataaacaccacgtgtgaaagaa

SEQ ID NO: 284 - DNA, 23 bp, Artificial Sequence
  Description of Artificial Sequence: Synthetic oligonucleotide
tgccgtctttgttagcaccatag

SEQ ID NO: 285 - DNA, 26 bp, Artificial Sequence
  Description of Artificial Sequence: Synthetic oligonucleotide
taaagttagaagtttgatagattcct

SEQ ID NO: 286 - DNA, 21 bp, Artificial Sequence
  Description of Artificial Sequence: Synthetic oligonucleotide
ggctctgttggtgggaatgtt

SEQ ID NO: 287 - DNA, 19 bp, Artificial Sequence
  Description of Artificial Sequence: Synthetic oligonucleotide
ttagcgctagcacgtggaa

SEQ ID NO: 288 - DNA, 24 bp, Artificial Sequence
  Description of Artificial Sequence: Synthetic oligonucleotide
atttggacattccccattgaaggt

SEQ ID NO: 289 - DNA, 24 bp, Artificial Sequence
  Description of Artificial Sequence: Synthetic oligonucleotide
cgtctggtagctcttcggtagtag

SEQ ID NO: 290 - DNA, 25 bp, Artificial Sequence
  Description of Artificial Sequence: Synthetic oligonucleotide
catgagagttgaaaggcacatttgg

SEQ ID NO: 291 - DNA, 22 bp, Artificial Sequence
  Description of Artificial Sequence: Synthetic oligonucleotide
ggtcatctggactgctattggt

SEQ ID NO: 292 - DNA, 22 bp, Artificial Sequence
  Description of Artificial Sequence: Synthetic oligonucleotide
acccacataataagctgcagca

SEQ ID NO: 293 - DNA, 28 bp, Artificial Sequence
  Description of Artificial Sequence: Synthetic oligonucleotide
gatttcaacgtacactttgtttctgaga

SEQ ID NO: 294 - DNA, 18 bp, Artificial Sequence
  Description of Artificial Sequence: Synthetic oligonucleotide
catgccaatgcgcgacat

SEQ ID NO: 295 - DNA, 25 bp, Artificial Sequence
  Description of Artificial Sequence: Synthetic oligonucleotide
ttgttggcctttaccagacattttg

SEQ ID NO: 296 - DNA, 22 bp, Artificial Sequence
  Description of Artificial Sequence: Synthetic oligonucleotide
gccttttggcaatgttgttcct

SEQ ID NO: 297 - DNA, 23 bp, Artificial Sequence
  Description of Artificial Sequence: Synthetic oligonucleotide
tgcgttctccattctggttactg

SEQ ID NO: 298 - DNA, 22 bp, Artificial Sequence
  Description of Artificial Sequence: Synthetic oligonucleotide
cgggtgccaatgtgatcttttg

SEQ ID NO: 299 - DNA, 24 bp, Artificial Sequence
  Description of Artificial Sequence: Synthetic oligonucleotide
agctgtccaacctgaagaagaatc

SEQ ID NO: 300 - DNA, 24 bp, Artificial Sequence
  Description of Artificial Sequence: Synthetic oligonucleotide
ctgagggagatcacgcactaaatt

SEQ ID NO: 301 - DNA, 25 bp, Artificial Sequence
  Description of Artificial Sequence: Synthetic oligonucleotide
tctcaagctggttcaatctgtcaag

SEQ ID NO: 302 - DNA, 22 bp, Artificial Sequence
  Description of Artificial Sequence: Synthetic oligonucleotide
tctgccgaaagcttgtgttaca

SEQ ID NO: 303 - DNA, 24 bp, Artificial Sequence
  Description of Artificial Sequence: Synthetic oligonucleotide
agcaggaagaagagtcacagtttg

SEQ ID NO: 304 - DNA, 21 bp, Artificial Sequence
  Description of Artificial Sequence: Synthetic oligonucleotide
tctgcggtaaggcttgagttt

SEQ ID NO: 305 - DNA, 23 bp, Artificial Sequence
  Description of Artificial Sequence: Synthetic oligonucleotide
gccttttggcaatgttgttcctt

SEQ ID NO: 306 - DNA, 21 bp, Artificial Sequence
  Description of Artificial Sequence: Synthetic oligonucleotide
cccgtctgccatgaagtttca

SEQ ID NO: 307 - DNA, 27 bp, Artificial Sequence
  Description of Artificial Sequence: Synthetic oligonucleotide
cgcactagaataaactctgaactcact

SEQ ID NO: 308 - DNA, 21 bp, Artificial Sequence
  Description of Artificial Sequence: Synthetic oligonucleotide
gccttgtcctcgagggaattt

SEQ ID NO: 309 - DNA, 22 bp, Artificial Sequence
  Description of Artificial Sequence: Synthetic oligonucleotide
tcatccaaatctgcagcaggaa

SEQ ID NO: 310 - DNA, 20 bp, Artificial Sequence
  Description of Artificial Sequence: Synthetic oligonucleotide
gggccgacgttgttttgatc

SEQ ID NO: 311 - DNA, 24 bp, Artificial Sequence
  Description of Artificial Sequence: Synthetic oligonucleotide
gattgcagcattgttagcaggatt

SEQ ID NO: 312 - DNA, 24 bp, Artificial Sequence
  Description of Artificial Sequence: Synthetic oligonucleotide
gccgaaagcttgtgttacattgta

SEQ ID NO: 313 - DNA, 23 bp, Artificial Sequence
  Description of Artificial Sequence: Synthetic oligonucleotide
aacccatatgatgccgtctttgt

SEQ ID NO: 314 - DNA, 25 bp, Artificial Sequence
  Description of Artificial Sequence: Synthetic oligonucleotide
ctgagggagatcacgcactaaatta

SEQ ID NO: 315 - DNA, 22 bp, Artificial Sequence
  Description of Artificial Sequence: Synthetic oligonucleotide
catgttgagtgagagcggtgaa

SEQ ID NO: 316 - DNA, 22 bp, Artificial Sequence
  Description of Artificial Sequence: Synthetic oligonucleotide
agctggttcaatctgtcaagca

SEQ ID NO: 317 - DNA, 19 bp, Artificial Sequence
  Description of Artificial Sequence: Synthetic oligonucleotide
gtgcgaccacccttacgaa

SEQ ID NO: 318 - DNA, 25 bp, Artificial Sequence
  Description of Artificial Sequence: Synthetic oligonucleotide
gcactaaattaataggcgtgtgctt

SEQ ID NO: 319 - DNA, 24 bp, Artificial Sequence
  Description of Artificial Sequence: Synthetic oligonucleotide
gcaaccaacataagagaacacaca

SEQ ID NO: 320 - DNA, 25 bp, Artificial Sequence
  Description of Artificial Sequence: Synthetic oligonucleotide
acgaagaatggttttcaagccagat

SEQ ID NO: 321 - DNA, 24 bp, Artificial Sequence
  Description of Artificial Sequence: Synthetic oligonucleotide
cgcaactggatagacagatcgaat

SEQ ID NO: 322 - DNA, 24 bp, Artificial Sequence
  Description of Artificial Sequence: Synthetic oligonucleotide
gcaagactatgctcaggtcctact

SEQ ID NO: 323 - DNA, 25 bp, Artificial Sequence
  Description of Artificial Sequence: Synthetic oligonucleotide
acaagtagtggcaccttctttagtc

SEQ ID NO: 324 - DNA, 22 bp, Artificial Sequence
  Description of Artificial Sequence: Synthetic oligonucleotide
aggtcttccttgccatgttgag

SEQ ID NO: 325 - DNA, 22 bp, Artificial Sequence
  Description of Artificial Sequence: Synthetic oligonucleotide
agagggtcaagtgcacagtcta

SEQ ID NO: 326 - DNA, 19 bp, Artificial Sequence
  Description of Artificial Sequence: Synthetic oligonucleotide
tgcgcgacattccgaagaa

SEQ ID NO: 327 - DNA, 24 bp, Artificial Sequence
  Description of Artificial Sequence: Synthetic oligonucleotide
tcgcaagtggctttaacaaaatcg

SEQ ID NO: 328 - DNA, 22 bp, Artificial Sequence
  Description of Artificial Sequence: Synthetic oligonucleotide
tcagcactgctcatggattgtt

SEQ ID NO: 329 - DNA, 23 bp, Artificial Sequence
  Description of Artificial Sequence: Synthetic oligonucleotide
tgctgcctggagttgaatttctt

SEQ ID NO: 330 - DNA, 21 bp, Artificial Sequence
  Description of Artificial Sequence: Synthetic oligonucleotide
ctctgcggtaaggcttgagtt

SEQ ID NO: 331 - DNA, 22 bp, Artificial Sequence
  Description of Artificial Sequence: Synthetic oligonucleotide
gggtaagtaaccacaagtagtg

SEQ ID NO: 332 - DNA, 22 bp, Artificial Sequence
  Description of Artificial Sequence: Synthetic oligonucleotide
gcgaccacccttacgaagaatg

SEQ ID NO: 333 - DNA, 25 bp, Artificial Sequence
  Description of Artificial Sequence: Synthetic oligonucleotide
tctttgttagcaccatagggaagtc

SEQ ID NO: 334 - DNA, 25 bp, Artificial Sequence
  Description of Artificial Sequence: Synthetic oligonucleotide
ccaatttggtcatctggactgctat

SEQ ID NO: 335 - DNA, 21 bp, Artificial Sequence
  Description of Artificial Sequence: Synthetic oligonucleotide
tgttgagtgagagcggtgaac

SEQ ID NO: 336 - DNA, 25 bp, Artificial Sequence
  Description of Artificial Sequence: Synthetic oligonucleotide
gtcatctggactgctattggtgtta

SEQ ID NO: 337 - DNA, 25 bp, Artificial Sequence
  Description of Artificial Sequence: Synthetic oligonucleotide
gtaggacagggttatcaaacctctt

SEQ ID NO: 338 - DNA, 20 bp, Artificial Sequence
  Description of Artificial Sequence: Synthetic oligonucleotide
aagcagcagcaaagcaagag

SEQ ID NO: 339 - DNA, 22 bp, Artificial Sequence
  Description of Artificial Sequence: Synthetic oligonucleotide
tttaccgtcaccaccacgaatt

SEQ ID NO: 340 - DNA, 23 bp, Artificial Sequence
  Description of Artificial Sequence: Synthetic oligonucleotide
ttcttgaactgttgcgactacgt

SEQ ID NO: 341 - DNA, 25 bp, Artificial Sequence
  Description of Artificial Sequence: Synthetic oligonucleotide
cctttaccagacattttgctctcaa

SEQ ID NO: 342 - DNA, 25 bp, Artificial Sequence
  Description of Artificial Sequence: Synthetic oligonucleotide
tgtatgctttagtggcagtacgttt

SEQ ID NO: 343 - DNA, 23 bp, Artificial Sequence
  Description of Artificial Sequence: Synthetic oligonucleotide
ttcctggtccccaaaatttcctt

SEQ ID NO: 344 - DNA, 21 bp, Artificial Sequence
  Description of Artificial Sequence: Synthetic oligonucleotide
cctgtgtaggtcaaccacgtt

SEQ ID NO: 345 - DNA, 19 bp, Artificial Sequence
  Description of Artificial Sequence: Synthetic oligonucleotide
cacgttcccgaaggtgtga

SEQ ID NO: 346 - DNA, 24 bp, Artificial Sequence
  Description of Artificial Sequence: Synthetic oligonucleotide
ctacgtgatgaggaacgagaagag

SEQ ID NO: 347 - DNA, 24 bp, Artificial Sequence
  Description of Artificial Sequence: Synthetic oligonucleotide
caggaagaagagtcacagtttgct

SEQ ID NO: 348 - DNA, 26 bp, Artificial Sequence
  Description of Artificial Sequence: Synthetic oligonucleotide
tctaccaatggttctaaagccgaaaa

SEQ ID NO: 349 - DNA, 23 bp, Artificial Sequence
  Description of Artificial Sequence: Synthetic oligonucleotide
ggaacccaataggcacacttgtt

SEQ ID NO: 350 - DNA, 23 bp, Artificial Sequence
  Description of Artificial Sequence: Synthetic oligonucleotide
ccacataataagctgcagcacca

SEQ ID NO: 351 - DNA, 22 bp, Artificial Sequence
  Description of Artificial Sequence: Synthetic oligonucleotide
gccttgtcctcgagggaattta

SEQ ID NO: 352 - DNA, 20 bp, Artificial Sequence
  Description of Artificial Sequence: Synthetic oligonucleotide
tggcccagttcctaggtagt

SEQ ID NO: 353 - DNA, 22 bp, Artificial Sequence
  Description of Artificial Sequence: Synthetic oligonucleotide
gagggtcaagtgcacagtctac

SEQ ID NO: 354 - DNA, 21 bp, Artificial Sequence
  Description of Artificial Sequence: Synthetic oligonucleotide
caccatagggaagtccagctt

SEQ ID NO: 355 - DNA, 25 bp, Artificial Sequence
  Description of Artificial Sequence: Synthetic oligonucleotide
tttgtcagggtaataaacaccacgt

SEQ ID NO: 356 - DNA, 24 bp, Artificial Sequence
  Description of Artificial Sequence: Synthetic oligonucleotide
caagactatgctcaggtcctactt

SEQ ID NO: 357 - DNA, 22 bp, Artificial Sequence
  Description of Artificial Sequence: Synthetic oligonucleotide
ttttaccgtcaccaccacgaat

SEQ ID NO: 358 - DNA, 21 bp, Artificial Sequence
  Description of Artificial Sequence: Synthetic oligonucleotide
gcaaagcaagagcagcatcac

SEQ ID NO: 359 - DNA, 24 bp, Artificial Sequence
  Description of Artificial Sequence: Synthetic oligonucleotide
ccctgttttccttcaaggtccata

SEQ ID NO: 360 - DNA, 25 bp, Artificial Sequence
  Description of Artificial Sequence: Synthetic oligonucleotide
caagactatgctcaggtcctacttc

SEQ ID NO: 361 - DNA, 25 bp, Artificial Sequence
  Description of Artificial Sequence: Synthetic oligonucleotide
caaggtccataagaaaaggctgaga

SEQ ID NO: 362 - DNA, 25 bp, Artificial Sequence
  Description of Artificial Sequence: Synthetic oligonucleotide
ctgattagttcctggtccccaaaat

SEQ ID NO: 363 - DNA, 25 bp, Artificial Sequence
  Description of Artificial Sequence: Synthetic oligonucleotide
ttgtatgctttagtggcagtacgtt

SEQ ID NO: 364 - DNA, 25 bp, Artificial Sequence
  Description of Artificial Sequence: Synthetic oligonucleotide
gtgggaatgttttgtatgcgtcaat

SEQ ID NO: 365 - DNA, 20 bp, Artificial Sequence
  Description of Artificial Sequence: Synthetic oligonucleotide
cgttcccgaaggtgtgactt

SEQ ID NO: 366 - DNA, 22 bp, Artificial Sequence
  Description of Artificial Sequence: Synthetic oligonucleotide
gtctgccgaaagcttgtgttac

SEQ ID NO: 367 - DNA, 16 bp, Artificial Sequence
  Description of Artificial Sequence: Synthetic oligonucleotide
cgccccactgcgttct

SEQ ID NO: 368 - DNA, 24 bp, Artificial Sequence
  Description of Artificial Sequence: Synthetic oligonucleotide
agctcttcggtagtagccaatttg

SEQ ID NO: 369 - DNA, 25 bp, Artificial Sequence
  Description of Artificial Sequence: Synthetic oligonucleotide
gtcctcgagggaatttaaggtcttc

SEQ ID NO: 370 - DNA, 24 bp, Artificial Sequence
  Description of Artificial Sequence: Synthetic oligonucleotide
ccttgaggaagttgtagcacgatt

SEQ ID NO: 371 - DNA, 22 bp, Artificial Sequence
  Description of Artificial Sequence: Synthetic oligonucleotide
gttgcgactacgtgatgaggaa

SEQ ID NO: 372 - DNA, 24 bp, Artificial Sequence
  Description of Artificial Sequence: Synthetic oligonucleotide
gcggccaatgtttgtaatcagttc

SEQ ID NO: 373 - DNA, 21 bp, Artificial Sequence
  Description of Artificial Sequence: Synthetic oligonucleotide
ccgtctgccatgaagtttcac

SEQ ID NO: 374 - DNA, 22 bp, Artificial Sequence
  Description of Artificial Sequence: Synthetic oligonucleotide
aatctgtcaagcagcagcaaag

SEQ ID NO: 375 - DNA, 25 bp, Artificial Sequence
  Description of Artificial Sequence: Synthetic oligonucleotide
gcacatttggttgcattcatttggt

SEQ ID NO: 376 - DNA, 25 bp, Artificial Sequence
  Description of Artificial Sequence: Synthetic oligonucleotide
ccatatgatgccgtctttgttagca

SEQ ID NO: 377 - DNA, 23 bp, Artificial Sequence
  Description of Artificial Sequence: Synthetic oligonucleotide
tggcctttaccagacattttgct

SEQ ID NO: 378 - DNA, 25 bp, Artificial Sequence
  Description of Artificial Sequence: Synthetic oligonucleotide
gccgaaagcttgtgttacattgtat

SEQ ID NO: 379 - DNA, 21 bp, Artificial Sequence
  Description of Artificial Sequence: Synthetic oligonucleotide
ttttaccgtcaccaccacgaa

SEQ ID NO: 380 - DNA, 26 bp, Artificial Sequence
  Description of Artificial Sequence: Synthetic oligonucleotide
ggcaaatctaccaatggttctaaagc

SEQ ID NO: 381 - DNA, 25 bp, Artificial Sequence
  Description of Artificial Sequence: Synthetic oligonucleotide
ctttgtttctgagagagggtcaagt

SEQ ID NO: 382 - DNA, 23 bp, Artificial Sequence
  Description of Artificial Sequence: Synthetic oligonucleotide
gccttgtcctcgagggaatttaa

SEQ ID NO: 383 - DNA, 24 bp, Artificial Sequence
  Description of Artificial Sequence: Synthetic oligonucleotide
tgaaattaccctgttttccttcaa

SEQ ID NO: 384 - DNA, 25 bp, Artificial Sequence
  Description of Artificial Sequence: Synthetic oligonucleotide
tttgtttctgagagagggtcaagtg

SEQ ID NO: 385 - DNA, 23 bp, Artificial Sequence
  Description of Artificial Sequence: Synthetic oligonucleotide
cgtagaagccttttggcaatgtt

SEQ ID NO: 386 - DNA, 21 bp, Artificial Sequence
  Description of Artificial Sequence: Synthetic oligonucleotide
actgcgttctccattctggtt

SEQ ID NO: 387 - DNA, 28 bp, Artificial Sequence
  Description of Artificial Sequence: Synthetic oligonucleotide
gtggtaataaacacccaaaaatggatca

SEQ ID NO: 388 - DNA, 21 bp, Artificial Sequence
  Description of Artificial Sequence: Synthetic oligonucleotide
ttctggcccagttcctaggta

SEQ ID NO: 389 - DNA, 19 bp, Artificial Sequence
  Description of Artificial Sequence: Synthetic oligonucleotide
caaccacgttcccgaaggt

SEQ ID NO: 390 - DNA, 22 bp, Artificial Sequence
  Description of Artificial Sequence: Synthetic oligonucleotide
cacgattgcagcattgttagca

SEQ ID NO: 391 - DNA, 25 bp, Artificial Sequence
  Description of Artificial Sequence: Synthetic oligonucleotide
agcagcagatttcttagtgacagtt

SEQ ID NO: 392 - DNA, 19 bp, Artificial Sequence
  Description of Artificial Sequence: Synthetic oligonucleotide
caaggctccctcagttgca

SEQ ID NO: 393 - DNA, 19 bp, Artificial Sequence
  Description of Artificial Sequence: Synthetic oligonucleotide
ttaggcctgagttgagtca

SEQ ID NO: 394 - DNA, 25 bp, Artificial Sequence
  Description of Artificial Sequence: Synthetic oligonucleotide
cggtagtagccaatttggtcatctg

SEQ ID NO: 395 - DNA, 23 bp, Artificial Sequence
  Description of Artificial Sequence: Synthetic oligonucleotide
agcctcagcagcagatttcttag

SEQ ID NO: 396 - DNA, 25 bp, Artificial Sequence
  Description of Artificial Sequence: Synthetic oligonucleotide
cgaagaatggttttcaagccagatt

SEQ ID NO: 397 - DNA, 21 bp, Artificial Sequence
  Description of Artificial Sequence: Synthetic oligonucleotide
ctgagggagatcacgcactaa

SEQ ID NO: 398 - DNA, 20 bp, Artificial Sequence
  Description of Artificial Sequence: Synthetic oligonucleotide
aggctctgttggtgggaatg

SEQ ID NO: 399 - DNA, 21 bp, Artificial Sequence
  Description of Artificial Sequence: Synthetic oligonucleotide
ggtgacgcaactggatagaca

SEQ ID NO: 400 - DNA, 26 bp, Artificial Sequence
  Description of Artificial Sequence: Synthetic oligonucleotide
agtcctaggttgaagataacccacat

SEQ ID NO: 401 - DNA, 23 bp, Artificial Sequence
  Description of Artificial Sequence: Synthetic oligonucleotide
cttccttgccatgttgagtgaga

SEQ ID NO: 402 - DNA, 22 bp, Artificial Sequence
  Description of Artificial Sequence: Synthetic oligonucleotide
tgaactgttgcgactacgtgat

SEQ ID NO: 403 - DNA, 28 bp, Artificial Sequence
  Description of Artificial Sequence: Synthetic oligonucleotide
cccttggttgaatagtcttgattatgga

SEQ ID NO: 404 - DNA, 23 bp, Artificial Sequence
  Description of Artificial Sequence: Synthetic oligonucleotide
ctctgttggtgggaatgttttgt

SEQ ID NO: 405 - DNA, 24 bp, Artificial Sequence
  Description of Artificial Sequence: Synthetic oligonucleotide
caatttgcggccaatgtttgtaat

SEQ ID NO: 406 - DNA, 25 bp, Artificial Sequence
  Description of Artificial Sequence: Synthetic oligonucleotide
gggtaataaacaccacgtgtgaaag

SEQ ID NO: 407 - DNA, 23 bp, Artificial Sequence
  Description of Artificial Sequence: Synthetic oligonucleotide
ccttgaggaagttgtagcacgat

SEQ ID NO: 408 - DNA, 24 bp, Artificial Sequence
  Description of Artificial Sequence: Synthetic oligonucleotide
tggtcccagagacatgtatagcat

SEQ ID NO: 409 - DNA, 25 bp, Artificial Sequence
  Description of Artificial Sequence: Synthetic oligonucleotide
agactatgctcaggtcctacttctg

SEQ ID NO: 410 - DNA, 25 bp, Artificial Sequence
  Description of Artificial Sequence: Synthetic oligonucleotide
aagactatgctcaggtcctacttct

SEQ ID NO: 411 - DNA, 25 bp, Artificial Sequence
  Description of Artificial Sequence: Synthetic oligonucleotide
ctgaagaagaatcaccaggagtcaa

SEQ ID NO: 412 - DNA, 25 bp, Artificial Sequence
  Description of Artificial Sequence: Synthetic oligonucleotide
ccttttggcaatgttgttccttgag

SEQ ID NO: 413 - DNA, 20 bp, Artificial Sequence
  Description of Artificial Sequence: Synthetic oligonucleotide
gcgggtgccaatgtgatctt

SEQ ID NO: 414 - DNA, 22 bp, Artificial Sequence
  Description of Artificial Sequence: Synthetic oligonucleotide
ttcggaaccttctccaacaaca

SEQ ID NO: 415 - DNA, 23 bp, Artificial Sequence
  Description of Artificial Sequence: Synthetic oligonucleotide
acagtttggccttgttgttgttg

SEQ ID NO: 416 - DNA, 22 bp, Artificial Sequence
  Description of Artificial Sequence: Synthetic oligonucleotide
agtgccacaaaattcgcaagtg

SEQ ID NO: 417 - DNA, 26 bp, Artificial Sequence
  Description of Artificial Sequence: Synthetic oligonucleotide
cagtggaagcaaaataaacaccatca

SEQ ID NO: 418 - DNA, 23 bp, Artificial Sequence
  Description of Artificial Sequence: Synthetic oligonucleotide
cactgcgttctccattctggtta

SEQ ID NO: 419 - DNA, 25 bp, Artificial Sequence
  Description of Artificial Sequence: Synthetic oligonucleotide
ccctgttttccttcaaggtccataa

SEQ ID NO: 420 - DNA, 23 bp, Artificial Sequence
  Description of Artificial Sequence: Synthetic oligonucleotide
gctctcaagctggttcaatctgt

SEQ ID NO: 421 - DNA, 24 bp, Artificial Sequence
  Description of Artificial Sequence: Synthetic oligonucleotide
aaaggcacatttggttgcattcat

SEQ ID NO: 422 - DNA, 21 bp, Artificial Sequence
  Description of Artificial Sequence: Synthetic oligonucleotide
cccactgcgttctccattctg

SEQ ID NO: 423 - DNA, 23 bp, Artificial Sequence
  Description of Artificial Sequence: Synthetic oligonucleotide
acgcacagaattttgagcagttt

SEQ ID NO: 424 - DNA, 21 bp, Artificial Sequence
  Description of Artificial Sequence: Synthetic oligonucleotide
agaacacacagcctccaaagg

SEQ ID NO: 425 - DNA, 25 bp, Artificial Sequence
  Description of Artificial Sequence: Synthetic oligonucleotide
aatttgcggccaatgtttgtaatca

SEQ ID NO: 426 - DNA, 23 bp, Artificial Sequence
  Description of Artificial Sequence: Synthetic oligonucleotide
tttcttctgtctctgcggtaagg

SEQ ID NO: 427 - DNA, 23 bp, Artificial Sequence
  Description of Artificial Sequence: Synthetic oligonucleotide
cctcagcagcagatttcttagtg

SEQ ID NO: 428 - DNA, 24 bp, Artificial Sequence
  Description of Artificial Sequence: Synthetic oligonucleotide
gctgtccaacctgaagaagaatca

SEQ ID NO: 429 - DNA, 23 bp, Artificial Sequence
  Description of Artificial Sequence: Synthetic oligonucleotide
cggtaaggcttgagtttcatcag

SEQ ID NO: 430 - DNA, 20 bp, Artificial Sequence
  Description of Artificial Sequence: Synthetic oligonucleotide
gcgaccacccttacgaagaa

SEQ ID NO: 431 - DNA, 22 bp, Artificial Sequence
  Description of Artificial Sequence: Synthetic oligonucleotide
ctggcccagttcctaggtagta

SEQ ID NO: 432 - DNA, 25 bp, Artificial Sequence
  Description of Artificial Sequence: Synthetic oligonucleotide
ggcccagttcctaggtagtagaaat

SEQ ID NO: 433 - DNA, 21 bp, Artificial Sequence
  Description of Artificial Sequence: Synthetic oligonucleotide
cactgctcatggattgttgca

SEQ ID NO: 434 - DNA, 20 bp, Artificial Sequence
  Description of Artificial Sequence: Synthetic oligonucleotide
cccgtctgccatgaagtttc

SEQ ID NO: 435 - DNA, 24 bp, Artificial Sequence
  Description of Artificial Sequence: Synthetic oligonucleotide
tttggtcatctggactgctattgg

SEQ ID NO: 436 - DNA, 21 bp, Artificial Sequence
  Description of Artificial Sequence: Synthetic oligonucleotide
tgcggtaaggcttgagtttca

SEQ ID NO: 437 - DNA, 24 bp, Artificial Sequence
  Description of Artificial Sequence: Synthetic oligonucleotide
gtagaagccttttggcaatgttgt

SEQ ID NO: 438 - DNA, 24 bp, Artificial Sequence
  Description of Artificial Sequence: Synthetic oligonucleotide
ggactgggtcttcgaatctaaagt

SEQ ID NO: 439 - DNA, 24 bp, Artificial Sequence
  Description of Artificial Sequence: Synthetic oligonucleotide
gtagggactgggtcttcgaatcta

SEQ ID NO: 440 - DNA, 25 bp, Artificial Sequence
  Description of Artificial Sequence: Synthetic oligonucleotide
ggtgaaccaagacgcagtattattg

SEQ ID NO: 441 - DNA, 25 bp, Artificial Sequence
  Description of Artificial Sequence: Synthetic oligonucleotide
aggtccataagaaaaggctgagaga

SEQ ID NO: 442 - DNA, 21 bp, Artificial Sequence
  Description of Artificial Sequence: Synthetic oligonucleotide
cgactacgtgatgaggaacga

SEQ ID NO: 443 - DNA, 24 bp, Artificial Sequence
  Description of Artificial Sequence: Synthetic oligonucleotide
agggtaataaacaccacgtgtgaa

SEQ ID NO: 444 - DNA, 26 bp, Artificial Sequence
  Description of Artificial Sequence: Synthetic oligonucleotide
cacgtgtgaaagaattagtgtatgca

SEQ ID NO: 445 - DNA, 25 bp, Artificial Sequence
  Description of Artificial Sequence: Synthetic oligonucleotide
ctgcctggagttgaatttcttgaac

SEQ ID NO: 446 - DNA, 22 bp, Artificial Sequence
  Description of Artificial Sequence: Synthetic oligonucleotide
gtgacgcaactggatagacaga

SEQ ID NO: 447 - DNA, 24 bp, Artificial Sequence
  Description of Artificial Sequence: Synthetic oligonucleotide
ctgcctggagttgaatttcttgaa

SEQ ID NO: 448 - DNA, 23 bp, Artificial Sequence
  Description of Artificial Sequence: Synthetic oligonucleotide
gcctcagcagcagatttcttagt

SEQ ID NO: 449 - DNA, 22 bp, Artificial Sequence
  Description of Artificial Sequence: Synthetic oligonucleotide
tcaagtgcacagtctacagcat

SEQ ID NO: 450 - DNA, 18 bp, Artificial Sequence
  Description of Artificial Sequence: Synthetic oligonucleotide
cgccattgccagccattc

SEQ ID NO: 451 - DNA, 25 bp, Artificial Sequence
  Description of Artificial Sequence: Synthetic oligonucleotide
agggtaataaacaccacgtgtgaaa

SEQ ID NO: 452 - DNA, 22 bp, Artificial Sequence
  Description of Artificial Sequence: Synthetic oligonucleotide
ccttcggaaccttctccaacaa

SEQ ID NO: 453 - DNA, 22 bp, Artificial Sequence
  Description of Artificial Sequence: Synthetic oligonucleotide
tgcggtaaggcttgagtttcat

SEQ ID NO: 454 - DNA, 20 bp, Artificial Sequence
  Description of Artificial Sequence: Synthetic oligonucleotide
accagctgtccaacctgaag

SEQ ID NO: 455 - DNA, 23 bp, Artificial Sequence
  Description of Artificial Sequence: Synthetic oligonucleotide
gccgtctttgttagcaccatagg

SEQ ID NO: 456 - DNA, 24 bp, Artificial Sequence
  Description of Artificial Sequence: Synthetic oligonucleotide
cctcagcagcagatttcttagtga

SEQ ID NO: 457 - DNA, 25 bp, Artificial Sequence
  Description of Artificial Sequence: Synthetic oligonucleotide
gactgggtcttcgaatctaaagtag

SEQ ID NO: 458 - DNA, 22 bp, Artificial Sequence
  Description of Artificial Sequence: Synthetic oligonucleotide
agtgcacagtctacagcatctg

SEQ ID NO: 459 - DNA, 16 bp, Artificial Sequence
  Description of Artificial Sequence: Synthetic oligonucleotide
accttcggaaccttct

SEQ ID NO: 460 - DNA, 22 bp, Artificial Sequence
  Description of Artificial Sequence: Synthetic oligonucleotide
ctccctcagttgcaacccatat

SEQ ID NO: 461 - DNA, 24 bp, Artificial Sequence
  Description of Artificial Sequence: Synthetic oligonucleotide
cttgtcctcgagggaatttaaggt

SEQ ID NO: 462 - DNA, 23 bp, Artificial Sequence
  Description of Artificial Sequence: Synthetic oligonucleotide
tggtgttaattggaacgccttgt

SEQ ID NO: 463 - DNA, 24 bp, Artificial Sequence
  Description of Artificial Sequence: Synthetic oligonucleotide
ccttttggcaatgttgttccttga

SEQ ID NO: 464 - DNA, 20 bp, Artificial Sequence
  Description of Artificial Sequence: Synthetic oligonucleotide
aagcagcagcaaagcaagag

SEQ ID NO: 465 - DNA, 24 bp, Artificial Sequence
  Description of Artificial Sequence: Synthetic oligonucleotide
cttgaggaagttgtagcacgattg

SEQ ID NO: 466 - DNA, 22 bp, Artificial Sequence
  Description of Artificial Sequence: Synthetic oligonucleotide
tcatccaaatctgcagcaggaa

SEQ ID NO: 467 - DNA, 25 bp, Artificial Sequence
  Description of Artificial Sequence: Synthetic oligonucleotide
tctccaacaacacctgtatggttac

SEQ ID NO: 468 - DNA, 23 bp, Artificial Sequence
  Description of Artificial Sequence: Synthetic oligonucleotide
agtgcgggagaaaattgatcgta

SEQ ID NO: 469 - DNA, 23 bp, Artificial Sequence
  Description of Artificial Sequence: Synthetic oligonucleotide
aaaggcacatttggttgcattca

SEQ ID NO: 470 - DNA, 21 bp, Artificial Sequence
  Description of Artificial Sequence: Synthetic oligonucleotide
ggaacgagaagaggcttgact

SEQ ID NO: 471 - DNA, 28 bp, Artificial Sequence
  Description of Artificial Sequence: Synthetic oligonucleotide
gactgggtcttcgaatctaaagtagtac

SEQ ID NO: 472 - DNA, 21 bp, Artificial Sequence
  Description of Artificial Sequence: Synthetic oligonucleotide
ctgcagcaggaagaagagtca

SEQ ID NO: 473 - DNA, 27 bp, Artificial Sequence
  Description of Artificial Sequence: Synthetic oligonucleotide
ttcaacgtacactttgtttctgagaga

SEQ ID NO: 474 - DNA, 21 bp, Artificial Sequence
  Description of Artificial Sequence: Synthetic oligonucleotide
gcgaccacccttacgaagaat

SEQ ID NO: 475 - DNA, 20 bp, Artificial Sequence
  Description of Artificial Sequence: Synthetic oligonucleotide
tctgctcccttctgcgtaga

SEQ ID NO: 476 - DNA, 23 bp, Artificial Sequence
  Description of Artificial Sequence: Synthetic oligonucleotide
gggtaattgagttctggttgtaa

SEQ ID NO: 477 - DNA, 23 bp, Artificial Sequence
  Description of Artificial Sequence: Synthetic oligonucleotide
cttgttgttgttggcctttacca

SEQ ID NO: 478 - DNA, 26 bp, Artificial Sequence
  Description of Artificial Sequence: Synthetic oligonucleotide
acagtgaaggatttcaacgtacactt

SEQ ID NO: 479 - DNA, 25 bp, Artificial Sequence
  Description of Artificial Sequence: Synthetic oligonucleotide
cacaaaattcgcaagtggctttaac

SEQ ID NO: 480 - DNA, 24 bp, Artificial Sequence
  Description of Artificial Sequence: Synthetic oligonucleotide
cagggtaataaacaccacgtgtga

SEQ ID NO: 481 - DNA, 23 bp, Artificial Sequence
  Description of Artificial Sequence: Synthetic oligonucleotide
ccctcagttgcaacccatatgat

SEQ ID NO: 482 - DNA, 23 bp, Artificial Sequence
  Description of Artificial Sequence: Synthetic oligonucleotide
ggtgttaattggaacgccttgtc

SEQ ID NO: 483 - DNA, 25 bp, Artificial Sequence
  Description of Artificial Sequence: Synthetic oligonucleotide
gggtaattgagttctggttgtaaga

SEQ ID NO: 484 - DNA, 22 bp, Artificial Sequence
  Description of Artificial Sequence: Synthetic oligonucleotide
gaactgttgcgactacgtgatg

SEQ ID NO: 485 - DNA, 25 bp, Artificial Sequence
  Description of Artificial Sequence: Synthetic oligonucleotide
acaaaattcgcaagtggctttaaca

SEQ ID NO: 486 - DNA, 23 bp, Artificial Sequence
  Description of Artificial Sequence: Synthetic oligonucleotide
cacataataagctgcagcaccag

SEQ ID NO: 487 - DNA, 18 bp, Artificial Sequence
  Description of Artificial Sequence: Synthetic oligonucleotide
gggccgacgttgttttga

SEQ ID NO: 488 - DNA, 19 bp, Artificial Sequence
  Description of Artificial Sequence: Synthetic oligonucleotide
cctactgctgcctggagtt

SEQ ID NO: 489 - DNA, 19 bp, Artificial Sequence
  Description of Artificial Sequence: Synthetic oligonucleotide
gcgcgacattccgaagaac

SEQ ID NO: 490 - DNA, 18 bp, Artificial Sequence
  Description of Artificial Sequence: Synthetic oligonucleotide
cagcatcaccgccattgc

SEQ ID NO: 491 - DNA, 18 bp, Artificial Sequence
  Description of Artificial Sequence: Synthetic oligonucleotide
cgcctctgctcccttctg

SEQ ID NO: 492 - DNA, 25 bp, Artificial Sequence
  Description of Artificial Sequence: Synthetic oligonucleotide
ctctgaactcactttccatccaact

SEQ ID NO: 493 - DNA, 21 bp, Artificial Sequence
  Description of Artificial Sequence: Synthetic oligonucleotide
gtgtgacttccatgccaatgc

SEQ ID NO: 494 - DNA, 22 bp, Artificial Sequence
  Description of Artificial Sequence: Synthetic oligonucleotide
gtgacagtttggccttgttgtt

SEQ ID NO: 495 - DNA, 22 bp, Artificial Sequence
  Description of Artificial Sequence: Synthetic oligonucleotide
agtgccacaaaattcgcaagtg

SEQ ID NO: 496 - DNA, 21 bp, Artificial Sequence
  Description of Artificial Sequence: Synthetic oligonucleotide
gtctgccgaaagcttgtgtta

SEQ ID NO: 497 - DNA, 20 bp, Artificial Sequence
  Description of Artificial Sequence: Synthetic oligonucleotide
agcacgtggaacccaatagg

SEQ ID NO: 498 - DNA, 22 bp, Artificial Sequence
  Description of Artificial Sequence: Synthetic oligonucleotide
tcggaaccttctccaacaacac

SEQ ID NO: 499 - DNA, 25 bp, Artificial Sequence
  Description of Artificial Sequence: Synthetic oligonucleotide
ggccaatgtttgtaatcagttcctt

SEQ ID NO: 500 - DNA, 25 bp, Artificial Sequence
  Description of Artificial Sequence: Synthetic oligonucleotide
gccatgaagtttcaccacaatgatc

SEQ ID NO: 501 - DNA, 25 bp, Artificial Sequence
  Description of Artificial Sequence: Synthetic oligonucleotide
gcctttaccagacattttgctctca

SEQ ID NO: 502 - DNA, 24 bp, Artificial Sequence
  Description of Artificial Sequence: Synthetic oligonucleotide
tggcaaccaacataagagaacaca

SEQ ID NO: 503 - DNA, 22 bp, Artificial Sequence
  Description of Artificial Sequence: Synthetic oligonucleotide
gcagcattgttagcaggattgc

SEQ ID NO: 504 - DNA, 21 bp, Artificial Sequence
  Description of Artificial Sequence: Synthetic oligonucleotide
ccattgccagccattctagca

SEQ ID NO: 505 - DNA, 25 bp, Artificial Sequence
  Description of Artificial Sequence: Synthetic oligonucleotide
caggattcaggtacatgaccatgag

SEQ ID NO: 506 - DNA, 15 bp, Artificial Sequence
  Description of Artificial Sequence: Synthetic oligonucleotide
acgctgcagtcctcg

SEQ ID NO: 507 - DNA, 24 bp, Artificial Sequence
  Description of Artificial Sequence: Synthetic oligonucleotide
caatcaggagagtcatgcctgtat

SEQ ID NO: 508 - DNA, 27 bp, Artificial Sequence
  Description of Artificial Sequence: Synthetic oligonucleotide
gcgggatcatcatctttttctagaaca

SEQ ID NO: 509 - DNA, 20 bp, Artificial Sequence
  Description of Artificial Sequence: Synthetic oligonucleotide
gcctgtgaacgcgagttaga

SEQ ID NO: 510 - DNA, 26 bp, Artificial Sequence
  Description of Artificial Sequence: Synthetic oligonucleotide
gcctttaccagacattttgctctcaa

SEQ ID NO: 511-519 - skipped (9 entries)

SEQ ID NO: 520 - DNA, 19 bp, Artificial Sequence
  Description of Artificial Sequence: Synthetic oligonucleotide
tagactgtgcacttgaccc

SEQ ID NO: 521 - DNA, 17 bp, Artificial Sequence
  Description of Artificial Sequence: Synthetic oligonucleotide
acgtttggtggaccctc

SEQ ID NO: 522 - DNA, 23 bp, Artificial Sequence
  Description of Artificial Sequence: Synthetic oligonucleotide
atcattacaaaattgaaattcac

SEQ ID NO: 523 - DNA, 18 bp, Artificial Sequence
  Description of Artificial Sequence: Synthetic oligonucleotide
caagacgcagtattattg

SEQ ID NO: 524 - DNA, 17 bp, Artificial Sequence
  Description of Artificial Sequence: Synthetic oligonucleotide
cttctggcccagttcct

SEQ ID NO: 525 - DNA, 16 bp, Artificial Sequence
  Description of Artificial Sequence: Synthetic oligonucleotide
actgccgcctctgctc

SEQ ID NO: 526 - DNA, 21 bp, Artificial Sequence
  Description of Artificial Sequence: Synthetic oligonucleotide
ctggatagacagatcgaattc

SEQ ID NO: 527 - DNA, 22 bp, Artificial Sequence
  Description of Artificial Sequence: Synthetic oligonucleotide
accaggagtcaaataacttcta

SEQ ID NO: 528 - DNA, 19 bp, Artificial Sequence
  Description of Artificial Sequence: Synthetic oligonucleotide
acccttggttgaatagtct

SEQ ID NO: 529 - DNA, 19 bp, Artificial Sequence
  Description of Artificial Sequence: Synthetic oligonucleotide
tcgcactagaataaactct

SEQ ID NO: 530 - DNA, 17 bp, Artificial Sequence
  Description of Artificial Sequence: Synthetic oligonucleotide
tcccaccaacagagcct

SEQ ID NO: 531 - DNA, 19 bp, Artificial Sequence
  Description of Artificial Sequence: Synthetic oligonucleotide
ctgcttgacagattgaacc

SEQ ID NO: 532 - DNA, 22 bp, Artificial Sequence
  Description of Artificial Sequence: Synthetic oligonucleotide
cagccttcttctttttgtcctt

SEQ ID NO: 533 - DNA, 17 bp, Artificial Sequence
  Description of Artificial Sequence: Synthetic oligonucleotide
attgtggtgaaacttca

SEQ ID NO: 534 - DNA, 18 bp, Artificial Sequence
  Description of Artificial Sequence: Synthetic oligonucleotide
ccgtctgccatgaagttt

SEQ ID NO: 535 - DNA, 19 bp, Artificial Sequence
  Description of Artificial Sequence: Synthetic oligonucleotide
cagcatgtcacaattcaga

SEQ ID NO: 536 - DNA, 22 bp, Artificial Sequence
  Description of Artificial Sequence: Synthetic oligonucleotide
ccactgagaagtctaacataat

SEQ ID NO: 537 - DNA, 16 bp, Artificial Sequence
  Description of Artificial Sequence: Synthetic oligonucleotide
actcctggtgattctt

SEQ ID NO: 538 - DNA, 17 bp, Artificial Sequence
  Description of Artificial Sequence: Synthetic oligonucleotide
ccccctgcatacactaa

SEQ ID NO: 539 - DNA, 23 bp, Artificial Sequence
  Description of Artificial Sequence: Synthetic oligonucleotide
atggttacaacctatgttagcgc

SEQ ID NO: 540 - DNA, 17 bp, Artificial Sequence
  Description of Artificial Sequence: Synthetic oligonucleotide
ccagaagctggacttcc

SEQ ID NO: 541 - DNA, 17 bp, Artificial Sequence
  Description of Artificial Sequence: Synthetic oligonucleotide
ctgccagttgaatctga

SEQ ID NO: 542 - DNA, 18 bp, Artificial Sequence
  Description of Artificial Sequence: Synthetic oligonucleotide
atggtgctaacaaagacg

SEQ ID NO: 543 - DNA, 17 bp, Artificial Sequence
  Description of Artificial Sequence: Synthetic oligonucleotide
acatggcaaggaagacc

SEQ ID NO: 544 - DNA, 18 bp, Artificial Sequence
  Description of Artificial Sequence: Synthetic oligonucleotide
taagaggctggatttttg

SEQ ID NO: 545 - DNA, 19 bp, Artificial Sequence
  Description of Artificial Sequence: Synthetic oligonucleotide
tcctcaaggaacaacattg

SEQ ID NO: 546 - DNA, 22 bp, Artificial Sequence
  Description of Artificial Sequence: Synthetic oligonucleotide
ttttgaaattaccctgttttcc

SEQ ID NO: 547 - DNA, 18 bp, Artificial Sequence
  Description of Artificial Sequence: Synthetic oligonucleotide
aaggctccctcagttgca

SEQ ID NO: 548 - DNA, 18 bp, Artificial Sequence
  Description of Artificial Sequence: Synthetic oligonucleotide
ttcctggtccccaaaatt

SEQ ID NO: 549 - DNA, 21 bp, Artificial Sequence
  Description of Artificial Sequence: Synthetic oligonucleotide
cttcaaggtccataagaaaag

SEQ ID NO: 550 - DNA, 17 bp, Artificial Sequence
  Description of Artificial Sequence: Synthetic oligonucleotide
tcctggtccccaaaatt

SEQ ID NO: 551 - DNA, 19 bp, Artificial Sequence
  Description of Artificial Sequence: Synthetic oligonucleotide
tctcagtggaagcaaaata

SEQ ID NO: 552 - DNA, 18 bp, Artificial Sequence
  Description of Artificial Sequence: Synthetic oligonucleotide
caacagttcaagaaattc

SEQ ID NO: 553 - DNA, 19 bp, Artificial Sequence
  Description of Artificial Sequence: Synthetic oligonucleotide
cccaataggcacacttgtt

SEQ ID NO: 554 - DNA, 18 bp, Artificial Sequence
  Description of Artificial Sequence: Synthetic oligonucleotide
cctgtgtaggtcaaccac

SEQ ID NO: 555 - DNA, 19 bp, Artificial Sequence
  Description of Artificial Sequence: Synthetic oligonucleotide
accacaatgatcacacttc

SEQ ID NO: 556 - DNA, 16 bp, Artificial Sequence
  Description of Artificial Sequence: Synthetic oligonucleotide
acgtggtccagaacaa

SEQ ID NO: 557 - DNA, 18 bp, Artificial Sequence
  Description of Artificial Sequence: Synthetic oligonucleotide
aagcacacgcctattaat

SEQ ID NO: 558 - DNA, 21 bp, Artificial Sequence
  Description of Artificial Sequence: Synthetic oligonucleotide
ccttgaggaagttgtagcacg

SEQ ID NO: 559 - DNA, 20 bp, Artificial Sequence
  Description of Artificial Sequence: Synthetic oligonucleotide
cacctgtatggttacaacct

SEQ ID NO: 560 - DNA, 20 bp, Artificial Sequence
  Description of Artificial Sequence: Synthetic oligonucleotide
aagttcccctactgctgcct

SEQ ID NO: 561 - DNA, 20 bp, Artificial Sequence
  Description of Artificial Sequence: Synthetic oligonucleotide
caaattggatgacaaagatc

SEQ ID NO: 562 - DNA, 19 bp, Artificial Sequence
  Description of Artificial Sequence: Synthetic oligonucleotide
aacccaataggcacacttg

SEQ ID NO: 563 - DNA, 16 bp, Artificial Sequence
  Description of Artificial Sequence: Synthetic oligonucleotide
tttgcccccagcgctt

SEQ ID NO: 564 - DNA, 20 bp, Artificial Sequence
  Description of Artificial Sequence: Synthetic oligonucleotide
ccttgaatacaccaaaagat

SEQ ID NO: 565 - DNA, 20 bp, Artificial Sequence
  Description of Artificial Sequence: Synthetic oligonucleotide
cttgccgaataccataatga

SEQ ID NO: 566 - DNA, 19 bp, Artificial Sequence
  Description of Artificial Sequence: Synthetic oligonucleotide
acgcatacaaaacattccc

SEQ ID NO: 567 - DNA, 18 bp, Artificial Sequence
  Description of Artificial Sequence: Synthetic oligonucleotide
cacacgcctattaattta

SEQ ID NO: 568 - DNA, 19 bp, Artificial Sequence
  Description of Artificial Sequence: Synthetic oligonucleotide
aattggatgacaaagatcc

SEQ ID NO: 569 - DNA, 15 bp, Artificial Sequence
  Description of Artificial Sequence: Synthetic oligonucleotide
cagcctccaaaggca

SEQ ID NO: 570 - DNA, 18 bp, Artificial Sequence
  Description of Artificial Sequence: Synthetic oligonucleotide
aaggcgttccaattaaca

SEQ ID NO: 571 - DNA, 18 bp, Artificial Sequence
  Description of Artificial Sequence: Synthetic oligonucleotide
atctggcttgaaaaccat

SEQ ID NO: 572 - DNA, 15 bp, Artificial Sequence
  Description of Artificial Sequence: Synthetic oligonucleotide
tctgccgaaagcttg

SEQ ID NO: 573 - DNA, 17 bp, Artificial Sequence
  Description of Artificial Sequence: Synthetic oligonucleotide
acgtggaacccaatagg

SEQ ID NO: 574 - DNA, 19 bp, Artificial Sequence
  Description of Artificial Sequence: Synthetic oligonucleotide
ccattggtcccagagacat

SEQ ID NO: 575 - DNA, 20 bp, Artificial Sequence
  Description of Artificial Sequence: Synthetic oligonucleotide
tcttcaacctaggacttttc

SEQ ID NO: 576 - DNA, 18 bp, Artificial Sequence
  Description of Artificial Sequence: Synthetic oligonucleotide
ttgacgcatacaaaacat

SEQ ID NO: 577 - DNA, 15 bp, Artificial Sequence
  Description of Artificial Sequence: Synthetic oligonucleotide
cagcaccagctgtcc

SEQ ID NO: 578 - DNA, 20 bp, Artificial Sequence
  Description of Artificial Sequence: Synthetic oligonucleotide
cagtggaagcaaaataaaca

SEQ ID NO: 579 - DNA, 21 bp, Artificial Sequence
  Description of Artificial Sequence: Synthetic oligonucleotide
ccgaataccataatgaatctg

SEQ ID NO: 580 - DNA, 21 bp, Artificial Sequence
  Description of Artificial Sequence: Synthetic oligonucleotide
cccagtccctacttattgtta

SEQ ID NO: 581 - DNA, 19 bp, Artificial Sequence
  Description of Artificial Sequence: Synthetic oligonucleotide
ttgcaacccatatgatgcc

SEQ ID NO: 582 - DNA, 17 bp, Artificial Sequence
  Description of Artificial Sequence: Synthetic oligonucleotide
acaatgctgcaatcgtg

SEQ ID NO: 583 - DNA, 20 bp, Artificial Sequence
  Description of Artificial Sequence: Synthetic oligonucleotide
aaactctgaactcactttcc

SEQ ID NO: 584 - DNA, 17 bp, Artificial Sequence
  Description of Artificial Sequence: Synthetic oligonucleotide
accattggtagatttgc

SEQ ID NO: 585 - DNA, 21 bp, Artificial Sequence
  Description of Artificial Sequence: Synthetic oligonucleotide
ttctccattctggttactgcc

SEQ ID NO: 586 - DNA, 19 bp, Artificial Sequence
  Description of Artificial Sequence: Synthetic oligonucleotide
tagcaccatagggaagtcc

SEQ ID NO: 587 - DNA, 19 bp, Artificial Sequence
  Description of Artificial Sequence: Synthetic oligonucleotide
accttctttagtcaaattc

SEQ ID NO: 588 - DNA, 18 bp, Artificial Sequence
  Description of Artificial Sequence: Synthetic oligonucleotide
atgctggacaataaattt

SEQ ID NO: 589 - DNA, 16 bp, Artificial Sequence
  Description of Artificial Sequence: Synthetic oligonucleotide
ccctgagggagatcac

SEQ ID NO: 590 - DNA, 18 bp, Artificial Sequence
  Description of Artificial Sequence: Synthetic oligonucleotide
aagtagtaccaaaaatcc

SEQ ID NO: 591 - DNA, 18 bp, Artificial Sequence
  Description of Artificial Sequence: Synthetic oligonucleotide
caatcctgctaacaatgc

SEQ ID NO: 592 - DNA, 20 bp, Artificial Sequence
  Description of Artificial Sequence: Synthetic oligonucleotide
aagcctcttctcgttcctca

SEQ ID NO: 593 - DNA, 19 bp, Artificial Sequence
  Description of Artificial Sequence: Synthetic oligonucleotide
aatgtaacacaagctttcg

SEQ ID NO: 594 - DNA, 18 bp, Artificial Sequence
  Description of Artificial Sequence: Synthetic oligonucleotide
acgtggtccagaacaaac

SEQ ID NO: 595 - DNA, 20 bp, Artificial Sequence
  Description of Artificial Sequence: Synthetic oligonucleotide
ccgaagagctaccagacgaa

SEQ ID NO: 596 - DNA, 20 bp, Artificial Sequence
  Description of Artificial Sequence: Synthetic oligonucleotide
caccaaatgaatgcaaccaa

SEQ ID NO: 597 - DNA, 23 bp, Artificial Sequence
  Description of Artificial Sequence: Synthetic oligonucleotide
actgagaagtctaacataataag

SEQ ID NO: 598 - DNA, 21 bp, Artificial Sequence
  Description of Artificial Sequence: Synthetic oligonucleotide
caaggaactgattacaaacat

SEQ ID NO: 599 - DNA, 16 bp, Artificial Sequence
  Description of Artificial Sequence: Synthetic oligonucleotide
ttctcccgcactcttg

SEQ ID NO: 600 - DNA, 17 bp, Artificial Sequence
  Description of Artificial Sequence: Synthetic oligonucleotide
caagctggttcaatctg

SEQ ID NO: 601 - DNA, 20 bp, Artificial Sequence
  Description of Artificial Sequence: Synthetic oligonucleotide
ctcatgaagtgtgatcattg

SEQ ID NO: 602 - DNA, 23 bp, Artificial Sequence
  Description of Artificial Sequence: Synthetic oligonucleotide
ccaggagtcaaataacttctatg

SEQ ID NO: 603 - DNA, 19 bp, Artificial Sequence
  Description of Artificial Sequence: Synthetic oligonucleotide
atgcttattcagcaaaatg

SEQ ID NO: 604 - DNA, 18 bp, Artificial Sequence
  Description of Artificial Sequence: Synthetic oligonucleotide
tcacgtagtcgcaacagt

SEQ ID NO: 605 - DNA, 23 bp, Artificial Sequence
  Description of Artificial Sequence: Synthetic oligonucleotide
tagtcttgattatggaatttaag

SEQ ID NO: 606 - DNA, 21 bp, Artificial Sequence
  Description of Artificial Sequence: Synthetic oligonucleotide
cactttccatccaacttttgt

SEQ ID NO: 607 - DNA, 17 bp, Artificial Sequence
  Description of Artificial Sequence: Synthetic oligonucleotide
tcattgtggtgaaactt

SEQ ID NO: 608 - DNA, 19 bp, Artificial Sequence
  Description of Artificial Sequence: Synthetic oligonucleotide
ttggtcccagagacatgta

SEQ ID NO: 609 - DNA, 19 bp, Artificial Sequence
  Description of Artificial Sequence: Synthetic oligonucleotide
caatagcagtccagatgac

SEQ ID NO: 610 - DNA, 19 bp, Artificial Sequence
  Description of Artificial Sequence: Synthetic oligonucleotide
ttggtggaccctcagattc

SEQ ID NO: 611 - DNA, 23 bp, Artificial Sequence
  Description of Artificial Sequence: Synthetic oligonucleotide
caaacattgttcgtttagttgtt

SEQ ID NO: 612 - DNA, 20 bp, Artificial Sequence
  Description of Artificial Sequence: Synthetic oligonucleotide
tcatcagccttcttcttttt

SEQ ID NO: 613 - DNA, 19 bp, Artificial Sequence
  Description of Artificial Sequence: Synthetic oligonucleotide
ccaaacaattgcaacaatc

SEQ ID NO: 614 - DNA, 21 bp, Artificial Sequence
  Description of Artificial Sequence: Synthetic oligonucleotide
ccatttttgggtgtttattac

SEQ ID NO: 615 - DNA, 22 bp, Artificial Sequence
  Description of Artificial Sequence: Synthetic oligonucleotide
ccagttcctaggtagtagaaat

SEQ ID NO: 616 - DNA, 19 bp, Artificial Sequence
  Description of Artificial Sequence: Synthetic oligonucleotide
attcgtctggtagctcttc

SEQ ID NO: 617 - DNA, 20 bp, Artificial Sequence
  Description of Artificial Sequence: Synthetic oligonucleotide
caaagatcaagtcattttgc

SEQ ID NO: 618 - DNA, 18 bp, Artificial Sequence
  Description of Artificial Sequence: Synthetic oligonucleotide
ctggtaaaggccaacaac

SEQ ID NO: 619 - DNA, 18 bp, Artificial Sequence
  Description of Artificial Sequence: Synthetic oligonucleotide
accccctgcatacactaa

SEQ ID NO: 620 - DNA, 19 bp, Artificial Sequence
  Description of Artificial Sequence: Synthetic oligonucleotide
ccttctttagtcaaattct

SEQ ID NO: 621 - DNA, 16 bp, Artificial Sequence
  Description of Artificial Sequence: Synthetic oligonucleotide
ctggagttgaatttct

SEQ ID NO: 622 - DNA, 18 bp, Artificial Sequence
  Description of Artificial Sequence: Synthetic oligonucleotide
caaaatcgcccgtctgcc

SEQ ID NO: 623 - DNA, 17 bp, Artificial Sequence
  Description of Artificial Sequence: Synthetic oligonucleotide
caacaaggccaaactgt

SEQ ID NO: 624 - DNA, 17 bp, Artificial Sequence
  Description of Artificial Sequence: Synthetic oligonucleotide
ttggatgacaaagatcc

SEQ ID NO: 625 - DNA, 19 bp, Artificial Sequence
  Description of Artificial Sequence: Synthetic oligonucleotide
aatgaatgcaaccaaatgt

SEQ ID NO: 626 - DNA, 18 bp, Artificial Sequence
  Description of Artificial Sequence: Synthetic oligonucleotide
caaaatttggacattccc

SEQ ID NO: 627 - DNA, 19 bp, Artificial Sequence
  Description of Artificial Sequence: Synthetic oligonucleotide
ctgtaatggttccattttc

SEQ ID NO: 628 - DNA, 19 bp, Artificial Sequence
  Description of Artificial Sequence: Synthetic oligonucleotide
aagcctcttctcgttcctc

SEQ ID NO: 629 - DNA, 17 bp, Artificial Sequence
  Description of Artificial Sequence: Synthetic oligonucleotide
ccagcatgtcacaattc

SEQ ID NO: 630 - DNA, 21 bp, Artificial Sequence
  Description of Artificial Sequence: Synthetic oligonucleotide
cagttccttgtctgattagtt

SEQ ID NO: 631 - DNA, 18 bp, Artificial Sequence
  Description of Artificial Sequence: Synthetic oligonucleotide
ccgtcaccaccacgaatt

SEQ ID NO: 632 - DNA, 17 bp, Artificial Sequence
  Description of Artificial Sequence: Synthetic oligonucleotide
ccctgacaaagttttca

SEQ ID NO: 633 - DNA, 19 bp, Artificial Sequence
  Description of Artificial Sequence: Synthetic oligonucleotide
aaagtgtacgttgaaatcc

SEQ ID NO: 634 - DNA, 17 bp, Artificial Sequence
  Description of Artificial Sequence: Synthetic oligonucleotide
ctgagggtccaccaaac

SEQ ID NO: 635 - DNA, 19 bp, Artificial Sequence
  Description of Artificial Sequence: Synthetic oligonucleotide
tcaaaagtgcaattattcg

SEQ ID NO: 636 - DNA, 20 bp, Artificial Sequence
  Description of Artificial Sequence: Synthetic oligonucleotide
ctctagtcagtgtgttaatc

SEQ ID NO: 637 - DNA, 14 bp, Artificial Sequence
  Description of Artificial Sequence: Synthetic oligonucleotide
ctgccgaaagcttg

SEQ ID NO: 638 - DNA, 17 bp, Artificial Sequence
  Description of Artificial Sequence: Synthetic oligonucleotide
atcgcccgtctgccatg

SEQ ID NO: 639 - DNA, 18 bp, Artificial Sequence
  Description of Artificial Sequence: Synthetic oligonucleotide
aagaggcttgactgccgc

SEQ ID NO: 640 - DNA, 17 bp, Artificial Sequence
  Description of Artificial Sequence: Synthetic oligonucleotide
cctctgctcccttctgc

SEQ ID NO: 641 - DNA, 19 bp, Artificial Sequence
  Description of Artificial Sequence: Synthetic oligonucleotide
atggcaaccaacataagag

SEQ ID NO: 642 - DNA, 25 bp, Artificial Sequence
  Description of Artificial Sequence: Synthetic oligonucleotide
atggttccattttcattatatttta

SEQ ID NO: 643 - DNA, 17 bp, Artificial Sequence
  Description of Artificial Sequence: Synthetic oligonucleotide
ctgcgttctccattctg

SEQ ID NO: 644 - DNA, 20 bp, Artificial Sequence
  Description of Artificial Sequence: Synthetic oligonucleotide
ccaggagtcaaataacttct

SEQ ID NO: 645 - DNA, 19 bp, Artificial Sequence
  Description of Artificial Sequence: Synthetic oligonucleotide
caaaatttggacattcccc

SEQ ID NO: 646 - DNA, 18 bp, Artificial Sequence
  Description of Artificial Sequence: Synthetic oligonucleotide
tactgctgcctggagttg

SEQ ID NO: 647 - DNA, 25 bp, Artificial Sequence
  Description of Artificial Sequence: Synthetic oligonucleotide
ccatcaatattcttaaacacaaatt

SEQ ID NO: 648 - DNA, 20 bp, Artificial Sequence
  Description of Artificial Sequence: Synthetic oligonucleotide
aagagctaccagacgaattc

SEQ ID NO: 649 - DNA, 19 bp, Artificial Sequence
  Description of Artificial Sequence: Synthetic oligonucleotide
cctgtcctaccatttaatg

SEQ ID NO: 650 - DNA, 18 bp, Artificial Sequence
  Description of Artificial Sequence: Synthetic oligonucleotide
ccctgcatacactaattc

SEQ ID NO: 651 - DNA, 16 bp, Artificial Sequence
  Description of Artificial Sequence: Synthetic oligonucleotide
ctgccgaaagcttgtg

SEQ ID NO: 652 - DNA, 20 bp, Artificial Sequence
  Description of Artificial Sequence: Synthetic oligonucleotide
tcatgagagttgaaaggcac

SEQ ID NO: 653 - DNA, 22 bp, Artificial Sequence
  Description of Artificial Sequence: Synthetic oligonucleotide
ctgtgactcttcttcctgctgc

SEQ ID NO: 654 - DNA, 16 bp, Artificial Sequence
  Description of Artificial Sequence: Synthetic oligonucleotide
catggcaaggaagacc

SEQ ID NO: 655 - DNA, 18 bp, Artificial Sequence
  Description of Artificial Sequence: Synthetic oligonucleotide
cctgagcatagtcttgcc

SEQ ID NO: 656 - DNA, 16 bp, Artificial Sequence
  Description of Artificial Sequence: Synthetic oligonucleotide
tcaccaccacgaattc

SEQ ID NO: 657 - DNA, 19 bp, Artificial Sequence
  Description of Artificial Sequence: Synthetic oligonucleotide
aagaaggctgatgaaactc

SEQ ID NO: 658 - DNA, 16 bp, Artificial Sequence
  Description of Artificial Sequence: Synthetic oligonucleotide
ttccatgccaatgcgc

SEQ ID NO: 659 - DNA, 19 bp, Artificial Sequence
  Description of Artificial Sequence: Synthetic oligonucleotide
aagtggctttaacaaaatc

SEQ ID NO: 660 - DNA, 19 bp, Artificial Sequence
  Description of Artificial Sequence: Synthetic oligonucleotide
ttcggtagtagccaatttg

SEQ ID NO: 661 - DNA, 18 bp, Artificial Sequence
  Description of Artificial Sequence: Synthetic oligonucleotide
aagccatcaagctttttc

SEQ ID NO: 662 - DNA, 18 bp, Artificial Sequence
  Description of Artificial Sequence: Synthetic oligonucleotide
ctgcgttctccattctgg

SEQ ID NO: 663 - DNA, 19 bp, Artificial Sequence
  Description of Artificial Sequence: Synthetic oligonucleotide
ttggaacgccttgtcctcg

SEQ ID NO: 664 - DNA, 20 bp, Artificial Sequence
  Description of Artificial Sequence: Synthetic oligonucleotide
ttggacattccccattgaag

SEQ ID NO: 665 - DNA, 21 bp, Artificial Sequence
  Description of Artificial Sequence: Synthetic oligonucleotide
ctcgttcctcatcacgtagtc

SEQ ID NO: 666 - DNA, 17 bp, Artificial Sequence
  Description of Artificial Sequence: Synthetic oligonucleotide
ctgggtcttcgaatcta

SEQ ID NO: 667 - DNA, 19 bp, Artificial Sequence
  Description of Artificial Sequence: Synthetic oligonucleotide
tctacgcagaagggagcag

SEQ ID NO: 668 - DNA, 17 bp, Artificial Sequence
  Description of Artificial Sequence: Synthetic oligonucleotide
attggcatggaagtcac

SEQ ID NO: 669 - DNA, 21 bp, Artificial Sequence
  Description of Artificial Sequence: Synthetic oligonucleotide
tcagcaaaatgacttgatctt

SEQ ID NO: 670 - DNA, 19 bp, Artificial Sequence
  Description of Artificial Sequence: Synthetic oligonucleotide
cttcaacctaggacttttc

SEQ ID NO: 671 - DNA, 16 bp, Artificial Sequence
  Description of Artificial Sequence: Synthetic oligonucleotide
ctcctggtgattcttc

SEQ ID NO: 672 - DNA, 18 bp, Artificial Sequence
  Description of Artificial Sequence: Synthetic oligonucleotide
ttctagtgcgaataattg

SEQ ID NO: 673 - DNA, 18 bp, Artificial Sequence
  Description of Artificial Sequence: Synthetic oligonucleotide
ccgacgttgttttgatcg

SEQ ID NO: 674 - DNA, 17 bp, Artificial Sequence
  Description of Artificial Sequence: Synthetic oligonucleotide
cttgagagcaaaatgtc

SEQ ID NO: 675 - DNA, 18 bp, Artificial Sequence
  Description of Artificial Sequence: Synthetic oligonucleotide
ctctgggaccaatggtac

SEQ ID NO: 676 - DNA, 21 bp, Artificial Sequence
  Description of Artificial Sequence: Synthetic oligonucleotide
tctcatgaagtgtgatcattg

SEQ ID NO: 677 - DNA, 17 bp, Artificial Sequence
  Description of Artificial Sequence: Synthetic oligonucleotide
aaggcgttccaattaac

SEQ ID NO: 678 - DNA, 17 bp, Artificial Sequence
  Description of Artificial Sequence: Synthetic oligonucleotide
cagcagcagatttctta

SEQ ID NO: 679 - DNA, 17 bp, Artificial Sequence
  Description of Artificial Sequence: Synthetic oligonucleotide
caggtgccatcaaattg

SEQ ID NO: 680 - DNA, 18 bp, Artificial Sequence
  Description of Artificial Sequence: Synthetic oligonucleotide
aagggtggtcgcactatt

SEQ ID NO: 681 - DNA, 16 bp, Artificial Sequence
  Description of Artificial Sequence: Synthetic oligonucleotide
atcaccgccattgcca

SEQ ID NO: 682 - DNA, 15 bp, Artificial Sequence
  Description of Artificial Sequence: Synthetic oligonucleotide
cagcagcaaagcaag

SEQ ID NO: 683 - DNA, 17 bp, Artificial Sequence
  Description of Artificial Sequence: Synthetic oligonucleotide
cctattggcaaatctac

SEQ ID NO: 684 - DNA, 19 bp, Artificial Sequence
  Description of Artificial Sequence: Synthetic oligonucleotide
accagaactcaattacccc

SEQ ID NO: 685 - DNA, 20 bp, Artificial Sequence
  Description of Artificial Sequence: Synthetic oligonucleotide
catcactaggtttcaaactt

SEQ ID NO: 686 - DNA, 18 bp, Artificial Sequence
  Description of Artificial Sequence: Synthetic oligonucleotide
ccaacagagcctaaaaag

SEQ ID NO: 687 - DNA, 20 bp, Artificial Sequence
  Description of Artificial Sequence: Synthetic oligonucleotide
cattgtggtgaaacttcatg

SEQ ID NO: 688 - DNA, 22 bp, Artificial Sequence
  Description of Artificial Sequence: Synthetic oligonucleotide
aatattcttaaacacaaattcc

SEQ ID NO: 689 - DNA, 21 bp, Artificial Sequence
  Description of Artificial Sequence: Synthetic oligonucleotide
ccaatggtactaagaggtttg

SEQ ID NO: 690 - DNA, 20 bp, Artificial Sequence
  Description of Artificial Sequence: Synthetic oligonucleotide
actgccactaaagcatacaa

SEQ ID NO: 691 - DNA, 19 bp, Artificial Sequence
  Description of Artificial Sequence: Synthetic oligonucleotide
catagtcttgccgaatacc

SEQ ID NO: 692 - DNA, 18 bp, Artificial Sequence
  Description of Artificial Sequence: Synthetic oligonucleotide
acacaggtgccatcaaat

SEQ ID NO: 693 - DNA, 19 bp, Artificial Sequence
  Description of Artificial Sequence: Synthetic oligonucleotide
ctgggtcttcgaatctaaa

SEQ ID NO: 694 - DNA, 20 bp, Artificial Sequence
  Description of Artificial Sequence: Synthetic oligonucleotide
cattcaactcaggacttgtt

SEQ ID NO: 695 - DNA, 17 bp, Artificial Sequence
  Description of Artificial Sequence: Synthetic oligonucleotide
ccacgttcccgaaggtg

SEQ ID NO: 696 - DNA, 16 bp, Artificial Sequence
  Description of Artificial Sequence: Synthetic oligonucleotide
ccaatgcgcgacattc

SEQ ID NO: 697 - DNA, 20 bp, Artificial Sequence
  Description of Artificial Sequence: Synthetic oligonucleotide
acagatgctgtagactgtgc

SEQ ID NO: 698 - DNA, 19 bp, Artificial Sequence
  Description of Artificial Sequence: Synthetic oligonucleotide
aataagaggctggattttt

SEQ ID NO: 699 - DNA, 19 bp, Artificial Sequence
  Description of Artificial Sequence: Synthetic oligonucleotide
atggatcattacaaaattg

SEQ ID NO: 700 - DNA, 20 bp, Artificial Sequence
  Description of Artificial Sequence: Synthetic oligonucleotide
ccttacgaagaatggttttc

SEQ ID NO: 701 - DNA, 20 bp, Artificial Sequence
  Description of Artificial Sequence: Synthetic oligonucleotide
actcaggacttgttcttacc

SEQ ID NO: 702 - DNA, 17 bp, Artificial Sequence
  Description of Artificial Sequence: Synthetic oligonucleotide
aagcagcagcaaagcaa

SEQ ID NO: 703 - DNA, 18 bp, Artificial Sequence
  Description of Artificial Sequence: Synthetic oligonucleotide
acaaacccaaggaaattt

SEQ ID NO: 704 - DNA, 18 bp, Artificial Sequence
  Description of Artificial Sequence: Synthetic oligonucleotide
ccaatggttctaaagccg

SEQ ID NO: 705 - DNA, 20 bp, Artificial Sequence
  Description of Artificial Sequence: Synthetic oligonucleotide
acaatgtaacacaagctttc

SEQ ID NO: 706 - DNA, 17 bp, Artificial Sequence
  Description of Artificial Sequence: Synthetic oligonucleotide
caccgctctcactcaac

SEQ ID NO: 707 - DNA, 18 bp, Artificial Sequence
  Description of Artificial Sequence: Synthetic oligonucleotide
cccagtccctacttattg

SEQ ID NO: 708 - DNA, 14 bp, Artificial Sequence
  Description of Artificial Sequence: Synthetic oligonucleotide
ttgcggccaatgtt

SEQ ID NO: 709 - DNA, 17 bp, Artificial Sequence
  Description of Artificial Sequence: Synthetic oligonucleotide
ttgcggccaatgtttgt

SEQ ID NO: 710 - DNA, 18 bp, Artificial Sequence
  Description of Artificial Sequence: Synthetic oligonucleotide
tcagtggaagcaaaataa

SEQ ID NO: 711 - DNA, 21 bp, Artificial Sequence
  Description of Artificial Sequence: Synthetic oligonucleotide
cccttggttgaatagtcttga

SEQ ID NO: 712 - DNA, 17 bp, Artificial Sequence
  Description of Artificial Sequence: Synthetic oligonucleotide
cccaccaacagagccta

SEQ ID NO: 713 - DNA, 17 bp, Artificial Sequence
  Description of Artificial Sequence: Synthetic oligonucleotide
cacccttacgaagaatg

SEQ ID NO: 714 - DNA, 18 bp, Artificial Sequence
  Description of Artificial Sequence: Synthetic oligonucleotide
tcgtgctacaacttcctc

SEQ ID NO: 715 - DNA, 17 bp, Artificial Sequence
  Description of Artificial Sequence: Synthetic oligonucleotide
ctgcagcaccagctgtc

SEQ ID NO: 716 - DNA, 16 bp, Artificial Sequence
  Description of Artificial Sequence: Synthetic oligonucleotide
ctagcacgtggaaccc

SEQ ID NO: 717 - DNA, 18 bp, Artificial Sequence
  Description of Artificial Sequence: Synthetic oligonucleotide
cacacgtggtgtttatta

SEQ ID NO: 718 - DNA, 19 bp, Artificial Sequence
  Description of Artificial Sequence: Synthetic oligonucleotide
ctgagggagccttgaatac

SEQ ID NO: 719 - DNA, 19 bp, Artificial Sequence
  Description of Artificial Sequence: Synthetic oligonucleotide
ttcttaaacacaaattccc

SEQ ID NO: 720 - DNA, 16 bp, Artificial Sequence
  Description of Artificial Sequence: Synthetic oligonucleotide
cagcatgtcacaattc

SEQ ID NO: 721 - DNA, 19 bp, Artificial Sequence
  Description of Artificial Sequence: Synthetic oligonucleotide
cagggtttttcggctttag

SEQ ID NO: 722 - DNA, 17 bp, Artificial Sequence
  Description of Artificial Sequence: Synthetic oligonucleotide
accaggagtcaaataac

SEQ ID NO: 723 - DNA, 19 bp, Artificial Sequence
  Description of Artificial Sequence: Synthetic oligonucleotide
ccatatgatgccgtctttg

SEQ ID NO: 724 - DNA, 15 bp, Artificial Sequence
  Description of Artificial Sequence: Synthetic oligonucleotide
ccccagcgcttcagc

SEQ ID NO: 725 - DNA, 18 bp, Artificial Sequence
  Description of Artificial Sequence: Synthetic oligonucleotide
aatgtgcctttcaactct

SEQ ID NO: 726 - DNA, 20 bp, Artificial Sequence
  Description of Artificial Sequence: Synthetic oligonucleotide
aagatcacattggcacccgc

SEQ ID NO: 727 - DNA, 20 bp, Artificial Sequence
  Description of Artificial Sequence: Synthetic oligonucleotide
ccttgtctgattagttcctg

SEQ ID NO: 728 - DNA, 18 bp, Artificial Sequence
  Description of Artificial Sequence: Synthetic oligonucleotide
tcgcactagaataaactc

SEQ ID NO: 729 - DNA, 18 bp, Artificial Sequence
  Description of Artificial Sequence: Synthetic oligonucleotide
atgtctctcagccttttc

SEQ ID NO: 730 - DNA, 23 bp, Artificial Sequence
  Description of Artificial Sequence: Synthetic oligonucleotide
acaagaaaaacaaacattgttcg

SEQ ID NO: 731 - DNA, 22 bp, Artificial Sequence
  Description of Artificial Sequence: Synthetic oligonucleotide
ttaatgatggtgtttattttgc

SEQ ID NO: 732 - DNA, 18 bp, Artificial Sequence
  Description of Artificial Sequence: Synthetic oligonucleotide
cctctctcagaaacaaag

SEQ ID NO: 733 - DNA, 19 bp, Artificial Sequence
  Description of Artificial Sequence: Synthetic oligonucleotide
cagcaaactgtgactcttc

SEQ ID NO: 734 - DNA, 16 bp, Artificial Sequence
  Description of Artificial Sequence: Synthetic oligonucleotide
atcgcgccccactgcg

SEQ ID NO: 735 - DNA, 18 bp, Artificial Sequence
  Description of Artificial Sequence: Synthetic oligonucleotide
cacgtagtcgcaacagtt

SEQ ID NO: 736 - DNA, 19 bp, Artificial Sequence
  Description of Artificial Sequence: Synthetic oligonucleotide
ttggccgcaaattgcacaa

SEQ ID NO: 737 - DNA, 20 bp, Artificial Sequence
  Description of Artificial Sequence: Synthetic oligonucleotide
ccttctttagtcaaattctc

SEQ ID NO: 738 - DNA, 18 bp, Artificial Sequence
  Description of Artificial Sequence: Synthetic oligonucleotide
tcggtagtagccaatttg

SEQ ID NO: 739 - DNA, 16 bp, Artificial Sequence
  Description of Artificial Sequence: Synthetic oligonucleotide
ctgccagttgaatctg

SEQ ID NO: 740 - DNA, 16 bp, Artificial Sequence
  Description of Artificial Sequence: Synthetic oligonucleotide
ttttgccgaggcttct

SEQ ID NO: 741 - DNA, 17 bp, Artificial Sequence
  Description of Artificial Sequence: Synthetic oligonucleotide
ctgctgaggcttctaag

SEQ ID NO: 742 - DNA, 16 bp, Artificial Sequence
  Description of Artificial Sequence: Synthetic oligonucleotide
aaggctgatgaaactc

SEQ ID NO: 743 - DNA, 16 bp, Artificial Sequence
  Description of Artificial Sequence: Synthetic oligonucleotide
atttgcggccaatgtt

SEQ ID NO: 744 - DNA, 21 bp, Artificial Sequence
  Description of Artificial Sequence: Synthetic oligonucleotide
atccatttttgggtgtttatt

SEQ ID NO: 745 - DNA, 18 bp, Artificial Sequence
  Description of Artificial Sequence: Synthetic oligonucleotide
aacatggcaaggaagacc

SEQ ID NO: 746 - DNA, 24 bp, Artificial Sequence
  Description of Artificial Sequence: Synthetic oligonucleotide
cctaggacttttctattaaaatat

SEQ ID NO: 747 - DNA, 20 bp, Artificial Sequence
  Description of Artificial Sequence: Synthetic oligonucleotide
caacgtacactttgtttctg

SEQ ID NO: 748 - DNA, 20 bp, Artificial Sequence
  Description of Artificial Sequence: Synthetic oligonucleotide
catgtatagcatggaaccaa

SEQ ID NO: 749 - DNA, 20 bp, Artificial Sequence
  Description of Artificial Sequence: Synthetic oligonucleotide
atcactaggtttcaaacttt

SEQ ID NO: 750 - DNA, 17 bp, Artificial Sequence
  Description of Artificial Sequence: Synthetic oligonucleotide
acatgctggacaataaa

SEQ ID NO: 751 - DNA, 18 bp, Artificial Sequence
  Description of Artificial Sequence: Synthetic oligonucleotide
ctgccagttgaatctgag

SEQ ID NO: 752 - DNA, 21 bp, Artificial Sequence
  Description of Artificial Sequence: Synthetic oligonucleotide
actctcatgaagtgtgatcat

SEQ ID NO: 753 - DNA, 22 bp, Artificial Sequence
  Description of Artificial Sequence: Synthetic oligonucleotide
aaagtctgtgaatttcaatttt

SEQ ID NO: 754 - DNA, 15 bp, Artificial Sequence
  Description of Artificial Sequence: Synthetic oligonucleotide
tcagcagcagatttc

SEQ ID NO: 755 - DNA, 15 bp, Artificial Sequence
  Description of Artificial Sequence: Synthetic oligonucleotide
ctgcggtaaggcttg

SEQ ID NO: 756 - DNA, 17 bp, Artificial Sequence
  Description of Artificial Sequence: Synthetic oligonucleotide
cattggcacccgcaatc

SEQ ID NO: 757 - DNA, 16 bp, Artificial Sequence
  Description of Artificial Sequence: Synthetic oligonucleotide
ccgaaggtgtgacttc

SEQ ID NO: 758 - DNA, 19 bp, Artificial Sequence
  Description of Artificial Sequence: Synthetic oligonucleotide
attaccccctgcatacact

SEQ ID NO: 759 - DNA, 20 bp, Artificial Sequence
  Description of Artificial Sequence: Synthetic oligonucleotide
tcgtggtggtgacggtaaaa

SEQ ID NO: 760 - DNA, 14 bp, Artificial Sequence
  Description of Artificial Sequence: Synthetic oligonucleotide
ttggccgcaaattg

SEQ ID NO: 761 - DNA, 25 bp, Artificial Sequence
  Description of Artificial Sequence: Synthetic oligonucleotide
catcaatattcttaaacacaaattc

SEQ ID NO: 762 - DNA, 16 bp, Artificial Sequence
  Description of Artificial Sequence: Synthetic oligonucleotide
ctcagtgccacaaaat

SEQ ID NO: 763 - DNA, 18 bp, Artificial Sequence
  Description of Artificial Sequence: Synthetic oligonucleotide
ccaagacgcagtattatt

SEQ ID NO: 764 - DNA, 17 bp, Artificial Sequence
  Description of Artificial Sequence: Synthetic oligonucleotide
caagagcagcatcaccg

SEQ ID NO: 765 - DNA, 18 bp, Artificial Sequence
  Description of Artificial Sequence: Synthetic oligonucleotide
accacgtgtgaaagaatt

SEQ ID NO: 766 - DNA, 19 bp, Artificial Sequence
  Description of Artificial Sequence: Synthetic oligonucleotide
actttgtcagggtaataaa

SEQ ID NO: 767 - DNA, 17 bp, Artificial Sequence
  Description of Artificial Sequence: Synthetic oligonucleotide
ttgcgggtgccaatgtg

SEQ ID NO: 768 - DNA, 17 bp, Artificial Sequence
  Description of Artificial Sequence: Synthetic oligonucleotide
aaggctgatgaaactca

SEQ ID NO: 769 - DNA, 19 bp, Artificial Sequence
  Description of Artificial Sequence: Synthetic oligonucleotide
cagatttggatgatttctc

SEQ ID NO: 770 - DNA, 18 bp, Artificial Sequence
  Description of Artificial Sequence: Synthetic oligonucleotide
cagcatgtcacaattcag

SEQ ID NO: 771 - DNA, 19 bp, Artificial Sequence
  Description of Artificial Sequence: Synthetic oligonucleotide
cctacacaggtgccatcaa

SEQ ID NO: 772 - DNA, 15 bp, Artificial Sequence
  Description of Artificial Sequence: Synthetic oligonucleotide
tcggccccaaggttt

SEQ ID NO: 773 - DNA, 18 bp, Artificial Sequence
  Description of Artificial Sequence: Synthetic oligonucleotide
aaccagaactcaattacc

SEQ ID NO: 774 - DNA, 14 bp, Artificial Sequence
  Description of Artificial Sequence: Synthetic oligonucleotide
atgcgcgacattcc

SEQ ID NO: 775 - DNA, 20 bp, Artificial Sequence
  Description of Artificial Sequence: Synthetic oligonucleotide
tagagactagtggcaataaa

SEQ ID NO: 776 - DNA, 21 bp, Artificial Sequence
  Description of Artificial Sequence: Synthetic oligonucleotide
caggacttgttcttacctttc

SEQ ID NO: 777 - DNA, 17 bp, Artificial Sequence
  Description of Artificial Sequence: Synthetic oligonucleotide
cacttgcgaattttgtg

SEQ ID NO: 778 - DNA, 21 bp, Artificial Sequence
  Description of Artificial Sequence: Synthetic oligonucleotide
aagtgagttcagagtttattc

SEQ ID NO: 779 - DNA, 19 bp, Artificial Sequence
  Description of Artificial Sequence: Synthetic oligonucleotide
aagagaacacacagcctcc

SEQ ID NO: 780 - DNA, 15 bp, Artificial Sequence
  Description of Artificial Sequence: Synthetic oligonucleotide
cacttgcgaattttg

SEQ ID NO: 781 - DNA, 24 bp, Artificial Sequence
  Description of Artificial Sequence: Synthetic oligonucleotide
atggttacaacctatgttagcgct

SEQ ID NO: 782 - DNA, 16 bp, Artificial Sequence
  Description of Artificial Sequence: Synthetic oligonucleotide
ctgccgcctctgctcc

SEQ ID NO: 783 - DNA, 16 bp, Artificial Sequence
  Description of Artificial Sequence: Synthetic oligonucleotide
tcggccccaaggttta

SEQ ID NO: 784 - DNA, 21 bp, Artificial Sequence
  Description of Artificial Sequence: Synthetic oligonucleotide
ttttcagatcctcagttttac

SEQ ID NO: 785 - DNA, 19 bp, Artificial Sequence
  Description of Artificial Sequence: Synthetic oligonucleotide
ttggtgtattcaaggctcc

SEQ ID NO: 786 - DNA, 16 bp, Artificial Sequence
  Description of Artificial Sequence: Synthetic oligonucleotide
tctctgcggtaaggct

SEQ ID NO: 787 - DNA, 19 bp, Artificial Sequence
  Description of Artificial Sequence: Synthetic oligonucleotide
accaaatgtgcctttcaac

SEQ ID NO: 788 - DNA, 17 bp, Artificial Sequence
  Description of Artificial Sequence: Synthetic oligonucleotide
cagttgcgtcaccaaat

SEQ ID NO: 789 - DNA, 17 bp, Artificial Sequence
  Description of Artificial Sequence: Synthetic oligonucleotide
acaggtgccatcaaatt

SEQ ID NO: 790 - DNA, 20 bp, Artificial Sequence
  Description of Artificial Sequence: Synthetic oligonucleotide
ttgtatttcccttaaattcc

SEQ ID NO: 791 - DNA, 18 bp, Artificial Sequence
  Description of Artificial Sequence: Synthetic oligonucleotide
acaagtagtggcaccttc

SEQ ID NO: 792 - DNA, 19 bp, Artificial Sequence
  Description of Artificial Sequence: Synthetic oligonucleotide
ccaggagtcaaataacttc

SEQ ID NO: 793 - DNA, 21 bp, Artificial Sequence
  Description of Artificial Sequence: Synthetic oligonucleotide
atcgaattctacccataaagc

SEQ ID NO: 794 - DNA, 23 bp, Artificial Sequence
  Description of Artificial Sequence: Synthetic oligonucleotide
ttgaaacctagtgatgttaatac

SEQ ID NO: 795 - DNA, 16 bp, Artificial Sequence
  Description of Artificial Sequence: Synthetic oligonucleotide
aacccaaggaaatttt

SEQ ID NO: 796 - DNA, 22 bp, Artificial Sequence
  Description of Artificial Sequence: Synthetic oligonucleotide
acatattcaaaagtgcaattat

SEQ ID NO: 797 - DNA, 21 bp, Artificial Sequence
  Description of Artificial Sequence: Synthetic oligonucleotide
caggtcctacttctgaattgt

SEQ ID NO: 798 - DNA, 20 bp, Artificial Sequence
  Description of Artificial Sequence: Synthetic oligonucleotide
ttgccgaataccataatgaa

SEQ ID NO: 799 - DNA, 17 bp, Artificial Sequence
  Description of Artificial Sequence: Synthetic oligonucleotide
ctccaaaggcaatagtg

SEQ ID NO: 800 - DNA, 19 bp, Artificial Sequence
  Description of Artificial Sequence: Synthetic oligonucleotide
ccaaggtttacccaataat

SEQ ID NO: 801 - DNA, 18 bp, Artificial Sequence
  Description of Artificial Sequence: Synthetic oligonucleotide
ttggaacgccttgtcctc

SEQ ID NO: 802 - DNA, 16 bp, Artificial Sequence
  Description of Artificial Sequence: Synthetic oligonucleotide
ttggcacccgcaatcc

SEQ ID NO: 803 - DNA, 19 bp, Artificial Sequence
  Description of Artificial Sequence: Synthetic oligonucleotide
caacaaggccaaactgtca

SEQ ID NO: 804 - DNA, 19 bp, Artificial Sequence
  Description of Artificial Sequence: Synthetic oligonucleotide
caaggaagaccttaaattc

SEQ ID NO: 805 - DNA, 18 bp, Artificial Sequence
  Description of Artificial Sequence: Synthetic oligonucleotide
tcgcaagtggctttaaca

SEQ ID NO: 806 - DNA, 20 bp, Artificial Sequence
  Description of Artificial Sequence: Synthetic oligonucleotide
acggtaaaatgaaagatctc

SEQ ID NO: 807 - DNA, 16 bp, Artificial Sequence
  Description of Artificial Sequence: Synthetic oligonucleotide
ccattgccagccattc

SEQ ID NO: 808 - DNA, 21 bp, Artificial Sequence
  Description of Artificial Sequence: Synthetic oligonucleotide
ccctaagatttttgaaattac

SEQ ID NO: 809 - DNA, 19 bp, Artificial Sequence
  Description of Artificial Sequence: Synthetic oligonucleotide
ctggtaaaggccaacaaca

SEQ ID NO: 810 - DNA, 20 bp, Artificial Sequence
  Description of Artificial Sequence: Synthetic oligonucleotide
ttcaaggtccataagaaaag

SEQ ID NO: 811 - DNA, 18 bp, Artificial Sequence
  Description of Artificial Sequence: Synthetic oligonucleotide
ctgctcatggattgttgc

SEQ ID NO: 812 - DNA, 23 bp, Artificial Sequence
  Description of Artificial Sequence: Synthetic oligonucleotide
cagccttcttctttttgtccttt

SEQ ID NO: 813 - DNA, 16 bp, Artificial Sequence
  Description of Artificial Sequence: Synthetic oligonucleotide
ctgctgcctggagttg

SEQ ID NO: 814 - DNA, 16 bp, Artificial Sequence
  Description of Artificial Sequence: Synthetic oligonucleotide
cctcagcagcagattt

SEQ ID NO: 815 - DNA, 20 bp, Artificial Sequence
  Description of Artificial Sequence: Synthetic oligonucleotide
ctagtcagtgtgttaatctt

SEQ ID NO: 816 - DNA, 19 bp, Artificial Sequence
  Description of Artificial Sequence: Synthetic oligonucleotide
tctggcttgaaaaccattc

SEQ ID NO: 817 - DNA, 20 bp, Artificial Sequence
  Description of Artificial Sequence: Synthetic oligonucleotide
cttccactgagaagtctaac

SEQ ID NO: 818 - DNA, 17 bp, Artificial Sequence
  Description of Artificial Sequence: Synthetic oligonucleotide
ttagtgcgtgatctccc

SEQ ID NO: 819 - DNA, 22 bp, Artificial Sequence
  Description of Artificial Sequence: Synthetic oligonucleotide
ttgagttctggttgtaagatta

SEQ ID NO: 820 - DNA, 18 bp, Artificial Sequence
  Description of Artificial Sequence: Synthetic oligonucleotide
tcttaaacacaaattccc

SEQ ID NO: 821 - DNA, 19 bp, Artificial Sequence
  Description of Artificial Sequence: Synthetic oligonucleotide
tttgatcgcgccccactgc

SEQ ID NO: 822 - DNA, 24 bp, Artificial Sequence
  Description of Artificial Sequence: Synthetic oligonucleotide
ttgttattaaagtctgtgaatttc

SEQ ID NO: 823 - DNA, 18 bp, Artificial Sequence
  Description of Artificial Sequence: Synthetic oligonucleotide
ctgtccaacctgaagaag

SEQ ID NO: 824 - DNA, 17 bp, Artificial Sequence
  Description of Artificial Sequence: Synthetic oligonucleotide
aaaacaacgtcggcccc

SEQ ID NO: 825 - DNA, 20 bp, Artificial Sequence
  Description of Artificial Sequence: Synthetic oligonucleotide
cagcaggaagaagagtcaca

SEQ ID NO: 826 - DNA, 20 bp, Artificial Sequence
  Description of Artificial Sequence: Synthetic oligonucleotide
atgctcaggtcctacttctg

SEQ ID NO: 827 - DNA, 17 bp, Artificial Sequence
  Description of Artificial Sequence: Synthetic oligonucleotide
aatctggcttgaaaacc

SEQ ID NO: 828 - DNA, 19 bp, Artificial Sequence
  Description of Artificial Sequence: Synthetic oligonucleotide
ctgcaatcgtgctacaact

SEQ ID NO: 829 - DNA, 17 bp, Artificial Sequence
  Description of Artificial Sequence: Synthetic oligonucleotide
tcgtctggtagctcttc

SEQ ID NO: 830 - DNA, 21 bp, Artificial Sequence
  Description of Artificial Sequence: Synthetic oligonucleotide
tcttagaagcctcagcagcag

SEQ ID NO: 831 - DNA, 18 bp, Artificial Sequence
  Description of Artificial Sequence: Synthetic oligonucleotide
acgtactgccactaaagc

SEQ ID NO: 832 - DNA, 21 bp, Artificial Sequence
  Description of Artificial Sequence: Synthetic oligonucleotide
ccctgtcctaccatttaatga

SEQ ID NO: 833 - DNA, 25 bp, Artificial Sequence
  Description of Artificial Sequence: Synthetic oligonucleotide
tcttgctttgctgctgcttgacaga

SEQ ID NO: 834 - DNA, 19 bp, Artificial Sequence
  Description of Artificial Sequence: Synthetic oligonucleotide
cacgtggtgtttattaccc

SEQ ID NO: 835 - DNA, 19 bp, Artificial Sequence
  Description of Artificial Sequence: Synthetic oligonucleotide
cagcatctgtaatggttcc

SEQ ID NO: 836 - DNA, 16 bp, Artificial Sequence
  Description of Artificial Sequence: Synthetic oligonucleotide
tagtgcgtgatctccc

SEQ ID NO: 837 - DNA, 20 bp, Artificial Sequence
  Description of Artificial Sequence: Synthetic oligonucleotide
ttcctaggtagtagaaatac

SEQ ID NO: 838 - DNA, 19 bp, Artificial Sequence
  Description of Artificial Sequence: Synthetic oligonucleotide
ctctcaagctggttcaatc

SEQ ID NO: 839 - DNA, 18 bp, Artificial Sequence
  Description of Artificial Sequence: Synthetic oligonucleotide
tagcaggagaagttcccc

SEQ ID NO: 840 - DNA, 19 bp, Artificial Sequence
  Description of Artificial Sequence: Synthetic oligonucleotide
aaccagaatggagaacgca

SEQ ID NO: 841 - DNA, 22 bp, Artificial Sequence
  Description of Artificial Sequence: Synthetic oligonucleotide
acataataagaggctggatttt

SEQ ID NO: 842 - DNA, 18 bp, Artificial Sequence
  Description of Artificial Sequence: Synthetic oligonucleotide
acgtagtcgcaacagttc

SEQ ID NO: 843 - DNA, 18 bp, Artificial Sequence
  Description of Artificial Sequence: Synthetic oligonucleotide
cactgctcatggattgtt

SEQ ID NO: 844 - DNA, 25 bp, Artificial Sequence
  Description of Artificial Sequence: Synthetic oligonucleotide
attgttaataacgctactaatgttg

SEQ ID NO: 845 - DNA, 17 bp, Artificial Sequence
  Description of Artificial Sequence: Synthetic oligonucleotide
tcgcaagtggctttaac

SEQ ID NO: 846 - DNA, 19 bp, Artificial Sequence
  Description of Artificial Sequence: Synthetic oligonucleotide
ctgctattggtgttaattg

SEQ ID NO: 847 - DNA, 20 bp, Artificial Sequence
  Description of Artificial Sequence: Synthetic oligonucleotide
aaggctgagagacatattca

SEQ ID NO: 848 - DNA, 24 bp, Artificial Sequence
  Description of Artificial Sequence: Synthetic oligonucleotide
atggttccattttcattatatttt

SEQ ID NO: 849 - DNA, 19 bp, Artificial Sequence
  Description of Artificial Sequence: Synthetic oligonucleotide
acttgatctttgaaatttg

SEQ ID NO: 850 - DNA, 19 bp, Artificial Sequence
  Description of Artificial Sequence: Synthetic oligonucleotide
tcactttccatccaacttt

SEQ ID NO: 851 - DNA, 18 bp, Artificial Sequence
  Description of Artificial Sequence: Synthetic oligonucleotide
attcccaccaacagagcc

SEQ ID NO: 852 - DNA, 16 bp, Artificial Sequence
  Description of Artificial Sequence: Synthetic oligonucleotide
tcgtgctacaacttcc

SEQ ID NO: 853 - DNA, 15 bp, Artificial Sequence
  Description of Artificial Sequence: Synthetic oligonucleotide
cctgctgcagatttg

SEQ ID NO: 854 - DNA, 22 bp, Artificial Sequence
  Description of Artificial Sequence: Synthetic oligonucleotide
tcctttttaggctctgttggtg

SEQ ID NO: 855 - DNA, 20 bp, Artificial Sequence
  Description of Artificial Sequence: Synthetic oligonucleotide
caaactgtgactcttcttcc

SEQ ID NO: 856 - DNA, 18 bp, Artificial Sequence
  Description of Artificial Sequence: Synthetic oligonucleotide
atgctgctcttgctttgc

SEQ ID NO: 857 - DNA, 18 bp, Artificial Sequence
  Description of Artificial Sequence: Synthetic oligonucleotide
acctattggcaaatctac

SEQ ID NO: 858 - DNA, 20 bp, Artificial Sequence
  Description of Artificial Sequence: Synthetic oligonucleotide
ctgccactaaagcatacaat

SEQ ID NO: 859 - DNA, 16 bp, Artificial Sequence
  Description of Artificial Sequence: Synthetic oligonucleotide
ctggaccacgtctgcc

SEQ ID NO: 860 - DNA, 18 bp, Artificial Sequence
  Description of Artificial Sequence: Synthetic oligonucleotide
aaggccaacaacaacaag

SEQ ID NO: 861 - DNA, 17 bp, Artificial Sequence
  Description of Artificial Sequence: Synthetic oligonucleotide
catggcaaggaagacct

SEQ ID NO: 862 - DNA, 18 bp, Artificial Sequence
  Description of Artificial Sequence: Synthetic oligonucleotide
ccaacctgaagaagaatc

SEQ ID NO: 863 - DNA, 15 bp, Artificial Sequence
  Description of Artificial Sequence: Synthetic oligonucleotide
ccccactgcgttctc

SEQ ID NO: 864 - DNA, 28 bp, Artificial Sequence
  Description of Artificial Sequence: Synthetic oligonucleotide
tcccagagacatgtatagcatggaacca

SEQ ID NO: 865 - DNA, 20 bp, Artificial Sequence
  Description of Artificial Sequence: Synthetic oligonucleotide
atagcatggaaccaagtaac

SEQ ID NO: 866 - DNA, 19 bp, Artificial Sequence
  Description of Artificial Sequence: Synthetic oligonucleotide
ctgcggtaaggcttgagtt

SEQ ID NO: 867 - DNA, 20 bp, Artificial Sequence
  Description of Artificial Sequence: Synthetic oligonucleotide
taataagaggctggattttt

SEQ ID NO: 868 - DNA, 18 bp, Artificial Sequence
  Description of Artificial Sequence: Synthetic oligonucleotide
acagggttatcaaacctc

SEQ ID NO: 869 - DNA, 17 bp, Artificial Sequence
  Description of Artificial Sequence: Synthetic oligonucleotide
actgccagttgaatctg

SEQ ID NO: 870 - DNA, 16 bp, Artificial Sequence
  Description of Artificial Sequence: Synthetic oligonucleotide
cacgtctgccgaaagc

SEQ ID NO: 871 - DNA, 18 bp, Artificial Sequence
  Description of Artificial Sequence: Synthetic oligonucleotide
cagtcaagcctcttctcg

SEQ ID NO: 872 - DNA, 17 bp, Artificial Sequence
  Description of Artificial Sequence: Synthetic oligonucleotide
aagaggctggatttttg

SEQ ID NO: 873 - DNA, 20 bp, Artificial Sequence
  Description of Artificial Sequence: Synthetic oligonucleotide
aacccttggttgaatagtct

SEQ ID NO: 874 - DNA, 20 bp, Artificial Sequence
  Description of Artificial Sequence: Synthetic oligonucleotide
aaaacgtactgccactaaag

SEQ ID NO: 875 - DNA, 24 bp, Artificial Sequence
  Description of Artificial Sequence: Synthetic oligonucleotide
atcaatattcttaaacacaaattc

SEQ ID NO: 876 - DNA, 17 bp, Artificial Sequence
  Description of Artificial Sequence: Synthetic oligonucleotide
acgattgcagcattgtt

SEQ ID NO: 877 - DNA, 19 bp, Artificial Sequence
  Description of Artificial Sequence: Synthetic oligonucleotide
atgaatctggcttgaaaac

SEQ ID NO: 878 - DNA, 18 bp, Artificial Sequence
  Description of Artificial Sequence: Synthetic oligonucleotide
cttggactgagatctttc

SEQ ID NO: 879 - DNA, 20 bp, Artificial Sequence
  Description of Artificial Sequence: Synthetic oligonucleotide
ccatcaagctttttcttttc

SEQ ID NO: 880 - DNA, 18 bp, Artificial Sequence
  Description of Artificial Sequence: Synthetic oligonucleotide
atgtgcctttcaactctc

SEQ ID NO: 881 - DNA, 19 bp, Artificial Sequence
  Description of Artificial Sequence: Synthetic oligonucleotide
aaggaagaccttaaattcc

SEQ ID NO: 882 - DNA, 20 bp, Artificial Sequence
  Description of Artificial Sequence: Synthetic oligonucleotide
atggaaccattacagatgct

SEQ ID NO: 883 - DNA, 20 bp, Artificial Sequence
  Description of Artificial Sequence: Synthetic oligonucleotide
aacagagcctaaaaaggaca

SEQ ID NO: 884 - DNA, 19 bp, Artificial Sequence
  Description of Artificial Sequence: Synthetic oligonucleotide
ttggcaatgttgttccttg

SEQ ID NO: 885 - DNA, 19 bp, Artificial Sequence
  Description of Artificial Sequence: Synthetic oligonucleotide
caagacgcagtattattgg

SEQ ID NO: 886 - DNA, 20 bp, Artificial Sequence
  Description of Artificial Sequence: Synthetic oligonucleotide
ttgttttgatcgcgccccac

SEQ ID NO: 887 - DNA, 18 bp, Artificial Sequence
  Description of Artificial Sequence: Synthetic oligonucleotide
actgtgcacttgaccctc

SEQ ID NO: 888 - DNA, 19 bp, Artificial Sequence
  Description of Artificial Sequence: Synthetic oligonucleotide
atgacaaagatccaaattt

SEQ ID NO: 889 - DNA, 22 bp, Artificial Sequence
  Description of Artificial Sequence: Synthetic oligonucleotide
cccagtccctacttattgttaa

SEQ ID NO: 890 - DNA, 19 bp, Artificial Sequence
  Description of Artificial Sequence: Synthetic oligonucleotide
ccataaagccatcaagctt

SEQ ID NO: 891 - DNA, 18 bp, Artificial Sequence
  Description of Artificial Sequence: Synthetic oligonucleotide
ccaagggttgaaaagaaa

SEQ ID NO: 892 - DNA, 16 bp, Artificial Sequence
  Description of Artificial Sequence: Synthetic oligonucleotide
atctggcttgaaaacc

SEQ ID NO: 893 - DNA, 19 bp, Artificial Sequence
  Description of Artificial Sequence: Synthetic oligonucleotide
ccagaacaaacccaaggaa

SEQ ID NO: 894 - DNA, 15 bp, Artificial Sequence
  Description of Artificial Sequence: Synthetic oligonucleotide
cctcagggtttttcg

SEQ ID NO: 895 - DNA, 19 bp, Artificial Sequence
  Description of Artificial Sequence: Synthetic oligonucleotide
tcgtggtggtgacggtaaa

SEQ ID NO: 896 - DNA, 25 bp, Artificial Sequence
  Description of Artificial Sequence: Synthetic oligonucleotide
taggcgtgtgcttagaatatatttt

SEQ ID NO: 897 - DNA, 18 bp, Artificial Sequence
  Description of Artificial Sequence: Synthetic oligonucleotide
cagcaaactgtgactctt

SEQ ID NO: 898 - DNA, 18 bp, Artificial Sequence
  Description of Artificial Sequence: Synthetic oligonucleotide
ctcagtggaagcaaaata

SEQ ID NO: 899 - DNA, 18 bp, Artificial Sequence
  Description of Artificial Sequence: Synthetic oligonucleotide
caagctggttcaatctgt

SEQ ID NO: 900 - DNA, 16 bp, Artificial Sequence
  Description of Artificial Sequence: Synthetic oligonucleotide
cctgagggagatcacg

SEQ ID NO: 901 - DNA, 18 bp, Artificial Sequence
  Description of Artificial Sequence: Synthetic oligonucleotide
tagtgcgaccacccttac

SEQ ID NO: 902 - DNA, 23 bp, Artificial Sequence
  Description of Artificial Sequence: Synthetic oligonucleotide
taggcgtgtgcttagaatatatt

SEQ ID NO: 903 - DNA, 18 bp, Artificial Sequence
  Description of Artificial Sequence: Synthetic oligonucleotide
ctggagttgaatttcttg

SEQ ID NO: 904 - DNA, 20 bp, Artificial Sequence
  Description of Artificial Sequence: Synthetic oligonucleotide
atgccgtctttgttagcacc

SEQ ID NO: 905 - DNA, 17 bp, Artificial Sequence
  Description of Artificial Sequence: Synthetic oligonucleotide
actagtggcaataaaac

SEQ ID NO: 906 - DNA, 19 bp, Artificial Sequence
  Description of Artificial Sequence: Synthetic oligonucleotide
ttgggttccacgtgctagc

SEQ ID NO: 907 - DNA, 24 bp, Artificial Sequence
  Description of Artificial Sequence: Synthetic oligonucleotide
cccagtccctacttattgttaata

SEQ ID NO: 908 - DNA, 23 bp, Artificial Sequence
  Description of Artificial Sequence: Synthetic oligonucleotide
acgctactaatgttgttattaaa

SEQ ID NO: 909 - DNA, 16 bp, Artificial Sequence
  Description of Artificial Sequence: Synthetic oligonucleotide
ccctgacaaagttttc

SEQ ID NO: 910 - DNA, 19 bp, Artificial Sequence
  Description of Artificial Sequence: Synthetic oligonucleotide
atgctgttgttaaaattta

SEQ ID NO: 911 - DNA, 18 bp, Artificial Sequence
  Description of Artificial Sequence: Synthetic oligonucleotide
ataagaggctggattttt

SEQ ID NO: 912 - DNA, 19 bp, Artificial Sequence
  Description of Artificial Sequence: Synthetic oligonucleotide
cagaagaaacagcaaactg

SEQ ID NO: 913 - DNA, 19 bp, Artificial Sequence
  Description of Artificial Sequence: Synthetic oligonucleotide
ctactgctgcctggagttg

SEQ ID NO: 914 - DNA, 20 bp, Artificial Sequence
  Description of Artificial Sequence: Synthetic oligonucleotide
atggaatttaagggaaatac

SEQ ID NO: 915 - DNA, 18 bp, Artificial Sequence
  Description of Artificial Sequence: Synthetic oligonucleotide
acaaagatccaaatttca

SEQ ID NO: 916 - DNA, 18 bp, Artificial Sequence
  Description of Artificial Sequence: Synthetic oligonucleotide
ctgctgcttgacagattg

SEQ ID NO: 917 - DNA, 20 bp, Artificial Sequence
  Description of Artificial Sequence: Synthetic oligonucleotide
taggcgtgtgcttagaatat

SEQ ID NO: 918 - DNA, 14 bp, Artificial Sequence
  Description of Artificial Sequence: Synthetic oligonucleotide
cagcagcagatttc

SEQ ID NO: 919 - DNA, 21 bp, Artificial Sequence
  Description of Artificial Sequence: Synthetic oligonucleotide
ctgccactaaagcatacaatg

SEQ ID NO: 920 - DNA, 21 bp, Artificial Sequence
  Description of Artificial Sequence: Synthetic oligonucleotide
taggcgtgtgcttagaatata

SEQ ID NO: 921 - DNA, 16 bp, Artificial Sequence
  Description of Artificial Sequence: Synthetic oligonucleotide
catcaccgccattgcc

SEQ ID NO: 922 - DNA, 20 bp, Artificial Sequence
  Description of Artificial Sequence: Synthetic oligonucleotide
cacaaattccctaagatttt

SEQ ID NO: 923 - DNA, 19 bp, Artificial Sequence
  Description of Artificial Sequence: Synthetic oligonucleotide
ccaccaacagagcctaaaa

SEQ ID NO: 924 - DNA, 16 bp, Artificial Sequence
  Description of Artificial Sequence: Synthetic oligonucleotide
tcagtgccacaaaatt

SEQ ID NO: 925 - DNA, 23 bp, Artificial Sequence
  Description of Artificial Sequence: Synthetic oligonucleotide
tactactttagattcgaagaccc

SEQ ID NO: 926 - DNA, 21 bp, Artificial Sequence
  Description of Artificial Sequence: Synthetic oligonucleotide
cagccttttcttatggacctt

SEQ ID NO: 927 - DNA, 21 bp, Artificial Sequence
  Description of Artificial Sequence: Synthetic oligonucleotide
cttgaatacaccaaaagatca

SEQ ID NO: 928 - DNA, 21 bp, Artificial Sequence
  Description of Artificial Sequence: Synthetic oligonucleotide
aagtctgtgaatttcaatttt

SEQ ID NO: 929 - DNA, 20 bp, Artificial Sequence
  Description of Artificial Sequence: Synthetic oligonucleotide
acccataaagccatcaagct

SEQ ID NO: 930 - DNA, 17 bp, Artificial Sequence
  Description of Artificial Sequence: Synthetic oligonucleotide
ctagtgcgaataattgc

SEQ ID NO: 931 - DNA, 19 bp, Artificial Sequence
  Description of Artificial Sequence: Synthetic oligonucleotide
caaaacaacgtcggcccca

SEQ ID NO: 932 - DNA, 16 bp, Artificial Sequence
  Description of Artificial Sequence: Synthetic oligonucleotide
aagaggctggattttt

SEQ ID NO: 933 - DNA, 23 bp, Artificial Sequence
  Description of Artificial Sequence: Synthetic oligonucleotide
ctagtggcaataaaacaagaaaa

SEQ ID NO: 934 - DNA, 19 bp, Artificial Sequence
  Description of Artificial Sequence: Synthetic oligonucleotide
acaaccagaactcaattac

SEQ ID NO: 935 - DNA, 19 bp, Artificial Sequence
  Description of Artificial Sequence: Synthetic oligonucleotide
atggaaccaagtaacattg

SEQ ID NO: 936 - DNA, 19 bp, Artificial Sequence
  Description of Artificial Sequence: Synthetic oligonucleotide
acgtactgccactaaagca

SEQ ID NO: 937 - DNA, 20 bp, Artificial Sequence
  Description of Artificial Sequence: Synthetic oligonucleotide
ctgtaatggttccattttca

SEQ ID NO: 938 - DNA, 19 bp, Artificial Sequence
  Description of Artificial Sequence: Synthetic oligonucleotide
tagcatggaaccaagtaac

SEQ ID NO: 939 - DNA, 18 bp, Artificial Sequence
  Description of Artificial Sequence: Synthetic oligonucleotide
tctgagggtccaccaaac

SEQ ID NO: 940 - DNA, 18 bp, Artificial Sequence
  Description of Artificial Sequence: Synthetic oligonucleotide
caatcgtgctacaacttc

SEQ ID NO: 941 - DNA, 22 bp, Artificial Sequence
  Description of Artificial Sequence: Synthetic oligonucleotide
ttggaaaagaaaggtaagaaca

SEQ ID NO: 942 - DNA, 14 bp, Artificial Sequence
  Description of Artificial Sequence: Synthetic oligonucleotide
tccccaaaatttcc

SEQ ID NO: 943 - DNA, 20 bp, Artificial Sequence
  Description of Artificial Sequence: Synthetic oligonucleotide
aaggctgatgaaactcaagc

SEQ ID NO: 944 - DNA, 18 bp, Artificial Sequence
  Description of Artificial Sequence: Synthetic oligonucleotide
ttgaaggtgtcaaatttc

SEQ ID NO: 945 - DNA, 18 bp, Artificial Sequence
  Description of Artificial Sequence: Synthetic oligonucleotide
tcgtctggtagctcttcg

SEQ ID NO: 946 - DNA, 18 bp, Artificial Sequence
  Description of Artificial Sequence: Synthetic oligonucleotide
ctcctgctagaatggctg

SEQ ID NO: 947 - DNA, 18 bp, Artificial Sequence
  Description of Artificial Sequence: Synthetic oligonucleotide
ctgcgtagaagccttttg

SEQ ID NO: 948 - DNA, 17 bp, Artificial Sequence
  Description of Artificial Sequence: Synthetic oligonucleotide
atggcaaggaagacctt

SEQ ID NO: 949 - DNA, 19 bp, Artificial Sequence
  Description of Artificial Sequence: Synthetic oligonucleotide
cccatatgatgccgtcttt

SEQ ID NO: 950 - DNA, 19 bp, Artificial Sequence
  Description of Artificial Sequence: Synthetic oligonucleotide
cagtccaagatggtatttc

SEQ ID NO: 951 - DNA, 18 bp, Artificial Sequence
  Description of Artificial Sequence: Synthetic oligonucleotide
cctgcatacactaattct

SEQ ID NO: 952 - DNA, 20 bp, Artificial Sequence
  Description of Artificial Sequence: Synthetic oligonucleotide
ctgcatacactaattctttc

SEQ ID NO: 953 - DNA, 19 bp, Artificial Sequence
  Description of Artificial Sequence: Synthetic oligonucleotide
ttgtttggagaaatcatcc

SEQ ID NO: 954 - DNA, 16 bp, Artificial Sequence
  Description of Artificial Sequence: Synthetic oligonucleotide
catgctggacaataaa

SEQ ID NO: 955 - DNA, 23 bp, Artificial Sequence
  Description of Artificial Sequence: Synthetic oligonucleotide
tcaatattcttaaacacaaattc

SEQ ID NO: 956 - DNA, 19 bp, Artificial Sequence
  Description of Artificial Sequence: Synthetic oligonucleotide
ttgcttccactgagaagtc

SEQ ID NO: 957 - DNA, 21 bp, Artificial Sequence
  Description of Artificial Sequence: Synthetic oligonucleotide
ctgtcctaccatttaatgatg

SEQ ID NO: 958 - DNA, 17 bp, Artificial Sequence
  Description of Artificial Sequence: Synthetic oligonucleotide
ttcccaccaacagagcc

SEQ ID NO: 959 - DNA, 20 bp, Artificial Sequence
  Description of Artificial Sequence: Synthetic oligonucleotide
aatgatggtgtttattttgc

SEQ ID NO: 960 - DNA, 20 bp, Artificial Sequence
  Description of Artificial Sequence: Synthetic oligonucleotide
attcttaaacacaaattccc

SEQ ID NO: 961 - DNA, 18 bp, Artificial Sequence
  Description of Artificial Sequence: Synthetic oligonucleotide
acctgaagaagaatcacc

SEQ ID NO: 962 - DNA, 26 bp, Artificial Sequence
  Description of Artificial Sequence: Synthetic oligonucleotide
accatcaatattcttaaacacaaatt

SEQ ID NO: 963 - DNA, 19 bp, Artificial Sequence
  Description of Artificial Sequence: Synthetic oligonucleotide
aagtagtggcaccttcttt

SEQ ID NO: 964 - DNA, 20 bp, Artificial Sequence
  Description of Artificial Sequence: Synthetic oligonucleotide
cctgagttgaatgtaaaact

SEQ ID NO: 965 - DNA, 24 bp, Artificial Sequence
  Description of Artificial Sequence: Synthetic oligonucleotide
cagtccctacttattgttaataac

SEQ ID NO: 966 - DNA, 15 bp, Artificial Sequence
  Description of Artificial Sequence: Synthetic oligonucleotide
ctggtccccaaaatt

SEQ ID NO: 967 - DNA, 17 bp, Artificial Sequence
  Description of Artificial Sequence: Synthetic oligonucleotide
ccacgtgtgaaagaatt

SEQ ID NO: 968 - DNA, 18 bp, Artificial Sequence
  Description of Artificial Sequence: Synthetic oligonucleotide
cagcgttcttcggaatgt

SEQ ID NO: 969 - DNA, 23 bp, Artificial Sequence
  Description of Artificial Sequence: Synthetic oligonucleotide
cccagtccctacttattgttaat

SEQ ID NO: 970 - DNA, 19 bp, Artificial Sequence
  Description of Artificial Sequence: Synthetic oligonucleotide
acagatgctgtagactgtg

SEQ ID NO: 971 - DNA, 20 bp, Artificial Sequence
  Description of Artificial Sequence: Synthetic oligonucleotide
cttgccgaataccataatga

SEQ ID NO: 972 - DNA, 19 bp, Artificial Sequence
  Description of Artificial Sequence: Synthetic oligonucleotide
cttggactgagatctttca

SEQ ID NO: 973 - DNA, 18 bp, Artificial Sequence
  Description of Artificial Sequence: Synthetic oligonucleotide
caattgtttggagaaatc

SEQ ID NO: 974 - DNA, 16 bp, Artificial Sequence
  Description of Artificial Sequence: Synthetic oligonucleotide
cccaccaacagagcct

SEQ ID NO: 975 - DNA, 22 bp, Artificial Sequence
  Description of Artificial Sequence: Synthetic oligonucleotide
cagttcctaggtagtagaaata

SEQ ID NO: 976 - DNA, 19 bp, Artificial Sequence
  Description of Artificial Sequence: Synthetic oligonucleotide
ttaccctgacaaagttttc

SEQ ID NO: 977 - DNA, 17 bp, Artificial Sequence
  Description of Artificial Sequence: Synthetic oligonucleotide
aatcgtgctacaacttc

SEQ ID NO: 978 - DNA, 14 bp, Artificial Sequence
  Description of Artificial Sequence: Synthetic oligonucleotide
cacccgcaatcctg

SEQ ID NO: 979 - DNA, 20 bp, Artificial Sequence
  Description of Artificial Sequence: Synthetic oligonucleotide
cacaatttgcccccagcgct

SEQ ID NO: 980 - DNA, 22 bp, Artificial Sequence
  Description of Artificial Sequence: Synthetic oligonucleotide
ccactaaagcatacaatgtaac

SEQ ID NO: 981 - DNA, 16 bp, Artificial Sequence
  Description of Artificial Sequence: Synthetic oligonucleotide
tttgccgaggcttctt

SEQ ID NO: 982 - DNA, 20 bp, Artificial Sequence
  Description of Artificial Sequence: Synthetic oligonucleotide
actaagaggtttgataaccc

SEQ ID NO: 983 - DNA, 17 bp, Artificial Sequence
  Description of Artificial Sequence: Synthetic oligonucleotide
cttgactgccgcctctg

SEQ ID NO: 984 - DNA, 21 bp, Artificial Sequence
  Description of Artificial Sequence: Synthetic oligonucleotide
tacaatgtaacacaagctttc

SEQ ID NO: 985 - DNA, 19 bp, Artificial Sequence
  Description of Artificial Sequence: Synthetic oligonucleotide
atgctggacaataaatttt

SEQ ID NO: 986 - DNA, 20 bp, Artificial Sequence
  Description of Artificial Sequence: Synthetic oligonucleotide
cccagagacatgtatagcat

SEQ ID NO: 987 - DNA, 17 bp, Artificial Sequence
  Description of Artificial Sequence: Synthetic oligonucleotide
ctgcggtaaggcttgag

SEQ ID NO: 988 - DNA, 20 bp, Artificial Sequence
  Description of Artificial Sequence: Synthetic oligonucleotide
atgtctctcagccttttctt

SEQ ID NO: 989 - DNA, 18 bp, Artificial Sequence
  Description of Artificial Sequence: Synthetic oligonucleotide
aagtgtacgttgaaatcc

SEQ ID NO: 990 - DNA, 19 bp, Artificial Sequence
  Description of Artificial Sequence: Synthetic oligonucleotide
tacttaccccaaaatgctg

SEQ ID NO: 991 - DNA, 17 bp, Artificial Sequence
  Description of Artificial Sequence: Synthetic oligonucleotide
ttgccgaggcttcttag

SEQ ID NO: 992 - DNA, 20 bp, Artificial Sequence
  Description of Artificial Sequence: Synthetic oligonucleotide
cagtccaagatggtatttct

SEQ ID NO: 993 - DNA, 20 bp, Artificial Sequence
  Description of Artificial Sequence: Synthetic oligonucleotide
atgcgtcaatatgcttattc

SEQ ID NO: 994 - DNA, 22 bp, Artificial Sequence
  Description of Artificial Sequence: Synthetic oligonucleotide
aagcaagtaaagtttgaaacct

SEQ ID NO: 995 - DNA, 22 bp, Artificial Sequence
  Description of Artificial Sequence: Synthetic oligonucleotide
ttcttagaagcctcagcagcag

SEQ ID NO: 996 - DNA, 16 bp, Artificial Sequence
  Description of Artificial Sequence: Synthetic oligonucleotide
ctccctcagggttttt

SEQ ID NO: 997 - DNA, 18 bp, Artificial Sequence
  Description of Artificial Sequence: Synthetic oligonucleotide
cctcaaggaacaacattg

SEQ ID NO: 998 - DNA, 15 bp, Artificial Sequence
  Description of Artificial Sequence: Synthetic oligonucleotide
cagacgggcgatttt

SEQ ID NO: 999 - DNA, 17 bp, Artificial Sequence
  Description of Artificial Sequence: Synthetic oligonucleotide
tctcagtgccacaaaat

SEQ ID NO: 1000 - DNA, 16 bp, Artificial Sequence
  Description of Artificial Sequence: Synthetic oligonucleotide
tctggcttgaaaacca

SEQ ID NO: 1001 - DNA, 20 bp, Artificial Sequence
  Description of Artificial Sequence: Synthetic oligonucleotide
cccttggttgaatagtcttg

SEQ ID NO: 1002 - DNA, 16 bp, Artificial Sequence
  Description of Artificial Sequence: Synthetic oligonucleotide
tagcaggagaagttcc

SEQ ID NO: 1003 - DNA, 16 bp, Artificial Sequence
  Description of Artificial Sequence: Synthetic oligonucleotide
ccagctgtccaacctg

SEQ ID NO: 1004 - DNA, 18 bp, Artificial Sequence
  Description of Artificial Sequence: Synthetic oligonucleotide
acattggcacccgcaatc

SEQ ID NO: 1005 - DNA, 17 bp, Artificial Sequence
  Description of Artificial Sequence: Synthetic oligonucleotide
ttgtggcactgagaatt

SEQ ID NO: 1006 - DNA, 23 bp, Artificial Sequence
  Description of Artificial Sequence: Synthetic oligonucleotide
tctatgtaaagcaagtaaagttt

SEQ ID NO: 1007 - DNA, 24 bp, Artificial Sequence
  Description of Artificial Sequence: Synthetic oligonucleotide
taggcgtgtgcttagaatatattt

SEQ ID NO: 1008 - DNA, 17 bp, Artificial Sequence
  Description of Artificial Sequence: Synthetic oligonucleotide
cagcatgtcacaattca

SEQ ID NO: 1009 - DNA, 17 bp, Artificial Sequence
  Description of Artificial Sequence: Synthetic oligonucleotide
cattgtggtgaaacttc

SEQ ID NO: 1010 - DNA, 22 bp, Artificial Sequence
  Description of Artificial Sequence: Synthetic oligonucleotide
ctagtggcaataaaacaagaaa

SEQ ID NO: 1011 - DNA, 22 bp, Artificial Sequence
  Description of Artificial Sequence: Synthetic oligonucleotide
tcttcaacctaggacttttcta

SEQ ID NO: 1012 - DNA, 15 bp, Artificial Sequence
  Description of Artificial Sequence: Synthetic oligonucleotide
ttgcggccaatgttt

SEQ ID NO: 1013 - DNA, 19 bp, Artificial Sequence
  Description of Artificial Sequence: Synthetic oligonucleotide
atgctcaggtcctacttct

SEQ ID NO: 1014 - DNA, 21 bp, Artificial Sequence
  Description of Artificial Sequence: Synthetic oligonucleotide
ttttctacagtgaaggatttc

SEQ ID NO: 1015 - DNA, 17 bp, Artificial Sequence
  Description of Artificial Sequence: Synthetic oligonucleotide
ccagaactcaattaccc

SEQ ID NO: 1016 - DNA, 19 bp, Artificial Sequence
  Description of Artificial Sequence: Synthetic oligonucleotide
caaagtgtacgttgaaatc

SEQ ID NO: 1017 - DNA, 19 bp, Artificial Sequence
  Description of Artificial Sequence: Synthetic oligonucleotide
ttggcctttaccagacatt

SEQ ID NO: 1018 - DNA, 17 bp, Artificial Sequence
  Description of Artificial Sequence: Synthetic oligonucleotide
ccaggagtcaaataact

SEQ ID NO: 1019 - DNA, 23 bp, Artificial Sequence
  Description of Artificial Sequence: Synthetic oligonucleotide
taaagtctgtgaatttcaatttt

SEQ ID NO: 1020 - DNA, 17 bp, Artificial Sequence
  Description of Artificial Sequence: Synthetic oligonucleotide
cacaggtgccatcaaat

SEQ ID NO: 1021 - DNA, 19 bp, Artificial Sequence
  Description of Artificial Sequence: Synthetic oligonucleotide
catggaaccaagtaacatt

SEQ ID NO: 1022 - DNA, 17 bp, Artificial Sequence
  Description of Artificial Sequence: Synthetic oligonucleotide
ccgtctgccatgaagtt

SEQ ID NO: 1023 - DNA, 18 bp, Artificial Sequence
  Description of Artificial Sequence: Synthetic oligonucleotide
ctgtcactaagaaatctg

SEQ ID NO: 1024 - DNA, 18 bp, Artificial Sequence
  Description of Artificial Sequence: Synthetic oligonucleotide
aacaacaaggccaaactg

SEQ ID NO: 1025 - DNA, 16 bp, Artificial Sequence
  Description of Artificial Sequence: Synthetic oligonucleotide
atgcgcgacattccga

SEQ ID NO: 1026 - DNA, 20 bp, Artificial Sequence
  Description of Artificial Sequence: Synthetic oligonucleotide
ctgagttgaatgtaaaactg

SEQ ID NO: 1027 - DNA, 20 bp, Artificial Sequence
  Description of Artificial Sequence: Synthetic oligonucleotide
cttgaatacaccaaaagatc

SEQ ID NO: 1028 - DNA, 17 bp, Artificial Sequence
  Description of Artificial Sequence: Synthetic oligonucleotide
ttgcgtcaccaaatgaa

SEQ ID NO: 1029 - DNA, 21 bp, Artificial Sequence
  Description of Artificial Sequence: Synthetic oligonucleotide
aagataacccacataataagc

SEQ ID NO: 1030 - DNA, 17 bp, Artificial Sequence
  Description of Artificial Sequence: Synthetic oligonucleotide
caaggcgttccaattaa

SEQ ID NO: 1031 - DNA, 19 bp, Artificial Sequence
  Description of Artificial Sequence: Synthetic oligonucleotide
aaagtagtaccaaaaatcc

SEQ ID NO: 1032 - DNA, 19 bp, Artificial Sequence
  Description of Artificial Sequence: Synthetic oligonucleotide
cctgcatacactaattctt

SEQ ID NO: 1033 - DNA, 24 bp, Artificial Sequence
  Description of Artificial Sequence: Synthetic oligonucleotide
ccagtccctacttattgttaataa

SEQ ID NO: 1034 - DNA, 15 bp, Artificial Sequence
  Description of Artificial Sequence: Synthetic oligonucleotide
caccaccacgaattc

SEQ ID NO: 1035 - DNA, 17 bp, Artificial Sequence
  Description of Artificial Sequence: Synthetic oligonucleotide
acaacaaggccaaactg

SEQ ID NO: 1036 - DNA, 18 bp, Artificial Sequence
  Description of Artificial Sequence: Synthetic oligonucleotide
ttgcgggtgccaatgtga

SEQ ID NO: 1037 - DNA, 16 bp, Artificial Sequence
  Description of Artificial Sequence: Synthetic oligonucleotide
ccaggagtcaaataac

SEQ ID NO: 1038 - DNA, 24 bp, Artificial Sequence
  Description of Artificial Sequence: Synthetic oligonucleotide
aacgctactaatgttgttattaaa

SEQ ID NO: 1039 - DNA, 19 bp, Artificial Sequence
  Description of Artificial Sequence: Synthetic oligonucleotide
acaaaatttggacattccc

SEQ ID NO: 1040 - DNA, 19 bp, Artificial Sequence
  Description of Artificial Sequence: Synthetic oligonucleotide
ttggctactaccgaagagc

SEQ ID NO: 1041 - DNA, 20 bp, Artificial Sequence
  Description of Artificial Sequence: Synthetic oligonucleotide
ctacagtgaaggatttcaac

SEQ ID NO: 1042 - DNA, 16 bp, Artificial Sequence
  Description of Artificial Sequence: Synthetic oligonucleotide
acagcctccaaaggca

SEQ ID NO: 1043 - DNA, 20 bp, Artificial Sequence
  Description of Artificial Sequence: Synthetic oligonucleotide
caaccaacataagagaacac

SEQ ID NO: 1044 - DNA, 19 bp, Artificial Sequence
  Description of Artificial Sequence: Synthetic oligonucleotide
tagtggcagtacgtttttg

SEQ ID NO: 1045 - DNA, 18 bp, Artificial Sequence
  Description of Artificial Sequence: Synthetic oligonucleotide
tactgccagttgaatctg

SEQ ID NO: 1046 - DNA, 18 bp, Artificial Sequence
  Description of Artificial Sequence: Synthetic oligonucleotide
atggattgttgcaattgt

SEQ ID NO: 1047 - DNA, 19 bp, Artificial Sequence
  Description of Artificial Sequence: Synthetic oligonucleotide
ctcgaggacaaggcgttcc

SEQ ID NO: 1048 - DNA, 20 bp, Artificial Sequence
  Description of Artificial Sequence: Synthetic oligonucleotide
catcagccttcttctttttg

SEQ ID NO: 1049 - DNA, 23 bp, Artificial Sequence
  Description of Artificial Sequence: Synthetic oligonucleotide
caacacgagcagcctctgatgca

SEQ ID NO: 1050 - DNA, 19 bp, Artificial Sequence
  Description of Artificial Sequence: Synthetic oligonucleotide
agcgctagcacgtggaacc

SEQ ID NO: 1051 - DNA, 20 bp, Artificial Sequence
  Description of Artificial Sequence: Synthetic oligonucleotide
cccaaaatgctgttgttaaa

SEQ ID NO: 1052 - DNA, 17 bp, Artificial Sequence
  Description of Artificial Sequence: Synthetic oligonucleotide
tagggactgggtcttcg

SEQ ID NO: 1053 - DNA, 15 bp, Artificial Sequence
  Description of Artificial Sequence: Synthetic oligonucleotide
cccagcgcttcagcg

SEQ ID NO: 1054 - DNA, 18 bp, Artificial Sequence
  Description of Artificial Sequence: Synthetic oligonucleotide
tccagttgcgtcaccaaa

SEQ ID NO: 1055 - DNA, 18 bp, Artificial Sequence
  Description of Artificial Sequence: Synthetic oligonucleotide
cagagacagaagaaacag

SEQ ID NO: 1056 - DNA, 22 bp, Artificial Sequence
  Description of Artificial Sequence: Synthetic oligonucleotide
cttgttcttacctttcttttcc

SEQ ID NO: 1057 - DNA, 22 bp, Artificial Sequence
  Description of Artificial Sequence: Synthetic oligonucleotide
tttgccaataggtattaacatc

SEQ ID NO: 1058 - DNA, 17 bp, Artificial Sequence
  Description of Artificial Sequence: Synthetic oligonucleotide
actgctgcctggagttg

SEQ ID NO: 1059 - DNA, 17 bp, Artificial Sequence
  Description of Artificial Sequence: Synthetic oligonucleotide
cagcatcaccgccattg

SEQ ID NO: 1060 - DNA, 20 bp, Artificial Sequence
  Description of Artificial Sequence: Synthetic oligonucleotide
aattcgtctggtagctcttc

SEQ ID NO: 1061 - DNA, 18 bp, Artificial Sequence
  Description of Artificial Sequence: Synthetic oligonucleotide
tagggaagtccagcttct

SEQ ID NO: 1062 - DNA, 20 bp, Artificial Sequence
  Description of Artificial Sequence: Synthetic oligonucleotide
tcgaattctacccataaagc

SEQ ID NO: 1063 - DNA, 21 bp, Artificial Sequence
  Description of Artificial Sequence: Synthetic oligonucleotide
ttacaaccagaactcaattac

SEQ ID NO: 1064 - DNA, 20 bp, Artificial Sequence
  Description of Artificial Sequence: Synthetic oligonucleotide
caaattccctaagatttttg

SEQ ID NO: 1065 - DNA, 18 bp, Artificial Sequence
  Description of Artificial Sequence: Synthetic oligonucleotide
cccaccaacagagcctaa

SEQ ID NO: 1066 - DNA, 19 bp, Artificial Sequence
  Description of Artificial Sequence: Synthetic oligonucleotide
accattggtcccagagaca

SEQ ID NO: 1067 - DNA, 18 bp, Artificial Sequence
  Description of Artificial Sequence: Synthetic oligonucleotide
acagagcctaaaaaggac

SEQ ID NO: 1068 - DNA, 18 bp, Artificial Sequence
  Description of Artificial Sequence: Synthetic oligonucleotide
actgaggatctgaaaact

SEQ ID NO: 1069 - DNA, 20 bp, Artificial Sequence
  Description of Artificial Sequence: Synthetic oligonucleotide
aaggaaaacagggtaatttc

SEQ ID NO: 1070 - DNA, 21 bp, Artificial Sequence
  Description of Artificial Sequence: Synthetic oligonucleotide
ctactttagattcgaagaccc

SEQ ID NO: 1071 - DNA, 19 bp, Artificial Sequence
  Description of Artificial Sequence: Synthetic oligonucleotide
ctagtggcaataaaacaag

SEQ ID NO: 1072 - DNA, 18 bp, Artificial Sequence
  Description of Artificial Sequence: Synthetic oligonucleotide
ttgtggcactgagaattt

SEQ ID NO: 1073 - DNA, 17 bp, Artificial Sequence
  Description of Artificial Sequence: Synthetic oligonucleotide
ccgcaaattgcacaatt

SEQ ID NO: 1074 - DNA, 15 bp, Artificial Sequence
  Description of Artificial Sequence: Synthetic oligonucleotide
acccaaggaaatttt

SEQ ID NO: 1075 - DNA, 19 bp, Artificial Sequence
  Description of Artificial Sequence: Synthetic oligonucleotide
catgagagttgaaaggcac

SEQ ID NO: 1076 - DNA, 16 bp, Artificial Sequence
  Description of Artificial Sequence: Synthetic oligonucleotide
ttgcccccagcgcttc

SEQ ID NO: 1077 - DNA, 19 bp, Artificial Sequence
  Description of Artificial Sequence: Synthetic oligonucleotide
atccagttgcgtcaccaaa

SEQ ID NO: 1078 - DNA, 18 bp, Artificial Sequence
  Description of Artificial Sequence: Synthetic oligonucleotide
aaggctgagagacatatt

SEQ ID NO: 1079 - DNA, 18 bp, Artificial Sequence
  Description of Artificial Sequence: Synthetic oligonucleotide
caaggctccctcagttgc

SEQ ID NO: 1080 - DNA, 21 bp, Artificial Sequence
  Description of Artificial Sequence: Synthetic oligonucleotide
tctctagtcagtgtgttaatc

SEQ ID NO: 1081 - DNA, 19 bp, Artificial Sequence
  Description of Artificial Sequence: Synthetic oligonucleotide
accctgtcctaccatttaa

SEQ ID NO: 1082 - DNA, 18 bp, Artificial Sequence
  Description of Artificial Sequence: Synthetic oligonucleotide
ttggtcccagagacatgt

SEQ ID NO: 1083 - DNA, 18 bp, Artificial Sequence
  Description of Artificial Sequence: Synthetic oligonucleotide
cagcttgagagcaaaatg

SEQ ID NO: 1084 - DNA, 19 bp, Artificial Sequence
  Description of Artificial Sequence: Synthetic oligonucleotide
aaggctgatgaaactcaag

SEQ ID NO: 1085 - DNA, 15 bp, Artificial Sequence
  Description of Artificial Sequence: Synthetic oligonucleotide
ctctgcggtaaggct

SEQ ID NO: 1086 - DNA, 17 bp, Artificial Sequence
  Description of Artificial Sequence: Synthetic oligonucleotide
cttggttcaccgctctc

SEQ ID NO: 1087 - DNA, 19 bp, Artificial Sequence
  Description of Artificial Sequence: Synthetic oligonucleotide
tcgaggacaaggcgttcca

SEQ ID NO: 1088 - DNA, 15 bp, Artificial Sequence
  Description of Artificial Sequence: Synthetic oligonucleotide
tagcacgtggaaccc

SEQ ID NO: 1089 - DNA, 18 bp, Artificial Sequence
  Description of Artificial Sequence: Synthetic oligonucleotide
ttggaggctgtgtgttct

SEQ ID NO: 1090 - DNA, 20 bp, Artificial Sequence
  Description of Artificial Sequence: Synthetic oligonucleotide
cctcatcacgtagtcgcaac

SEQ ID NO: 1091 - DNA, 18 bp, Artificial Sequence
  Description of Artificial Sequence: Synthetic oligonucleotide
aagaggctggatttttgg

SEQ ID NO: 1092 - DNA, 21 bp, Artificial Sequence
  Description of Artificial Sequence: Synthetic oligonucleotide
ttaatacctattggcaaatct

SEQ ID NO: 1093 - DNA, 19 bp, Artificial Sequence
  Description of Artificial Sequence: Synthetic oligonucleotide
aagccttaccgcagagaca

SEQ ID NO: 1094 - DNA, 18 bp, Artificial Sequence
  Description of Artificial Sequence: Synthetic oligonucleotide
acgtttttgccgaggctt

SEQ ID NO: 1095 - DNA, 23 bp, Artificial Sequence
  Description of Artificial Sequence: Synthetic oligonucleotide
tagtggcaataaaacaagaaaaa

SEQ ID NO: 1096 - DNA, 18 bp, Artificial Sequence
  Description of Artificial Sequence: Synthetic oligonucleotide
tcttggactgagatcttt

SEQ ID NO: 1097 - DNA, 20 bp, Artificial Sequence
  Description of Artificial Sequence: Synthetic oligonucleotide
tccaacttttgttgtttttg

SEQ ID NO: 1098 - DNA, 18 bp, Artificial Sequence
  Description of Artificial Sequence: Synthetic oligonucleotide
ttgtatgcgtcaatatgc

SEQ ID NO: 1099 - DNA, 19 bp, Artificial Sequence
  Description of Artificial Sequence: Synthetic oligonucleotide
atgtctctcagccttttct

SEQ ID NO: 1100 - DNA, 20 bp, Artificial Sequence
  Description of Artificial Sequence: Synthetic oligonucleotide
ctgcagatttggatgatttc

SEQ ID NO: 1101 - DNA, 16 bp, Artificial Sequence
  Description of Artificial Sequence: Synthetic oligonucleotide
caatgctgcaatcgtg

SEQ ID NO: 1102 - DNA, 19 bp, Artificial Sequence
  Description of Artificial Sequence: Synthetic oligonucleotide
ttgaaggtgtcaaatttct

SEQ ID NO: 1103 - DNA, 18 bp, Artificial Sequence
  Description of Artificial Sequence: Synthetic oligonucleotide
atcattgtggtgaaactt

SEQ ID NO: 1104 - DNA, 17 bp, Artificial Sequence
  Description of Artificial Sequence: Synthetic oligonucleotide
accctgacaaagttttc

SEQ ID NO: 1105 - DNA, 16 bp, Artificial Sequence
  Description of Artificial Sequence: Synthetic oligonucleotide
cctggtccccaaaatt

SEQ ID NO: 1106 - DNA, 16 bp, Artificial Sequence
  Description of Artificial Sequence: Synthetic oligonucleotide
tcgcgccccactgcgt

SEQ ID NO: 1107 - DNA, 20 bp, Artificial Sequence
  Description of Artificial Sequence: Synthetic oligonucleotide
ataggcgtgtgcttagaata

SEQ ID NO: 1108 - DNA, 18 bp, Artificial Sequence
  Description of Artificial Sequence: Synthetic oligonucleotide
ctgagggtccaccaaacg

SEQ ID NO: 1109 - DNA, 20 bp, Artificial Sequence
  Description of Artificial Sequence: Synthetic oligonucleotide
ctacttgtggttacttaccc

SEQ ID NO: 1110 - DNA, 21 bp, Artificial Sequence
  Description of Artificial Sequence: Synthetic oligonucleotide
cctgtcctaccatttaatgat

SEQ ID NO: 1111 - DNA, 19 bp, Artificial Sequence
  Description of Artificial Sequence: Synthetic oligonucleotide
atcacgtagtcgcaacagt

SEQ ID NO: 1112 - DNA, 18 bp, Artificial Sequence
  Description of Artificial Sequence: Synthetic oligonucleotide
aagtccagcttctggccc

SEQ ID NO: 1113 - DNA, 24 bp, Artificial Sequence
  Description of Artificial Sequence: Synthetic oligonucleotide
acaaacattgttcgtttagttgtt

SEQ ID NO: 1114 - DNA, 21 bp, Artificial Sequence
  Description of Artificial Sequence: Synthetic oligonucleotide
aaatggatcattacaaaattg

SEQ ID NO: 1115 - DNA, 17 bp, Artificial Sequence
  Description of Artificial Sequence: Synthetic oligonucleotide
ttgccagccattctagc

SEQ ID NO: 1116 - DNA, 18 bp, Artificial Sequence
  Description of Artificial Sequence: Synthetic oligonucleotide
ccgaagaacgctgaagcg

SEQ ID NO: 1117 - DNA, 19 bp, Artificial Sequence
  Description of Artificial Sequence: Synthetic oligonucleotide
caatagtgcgaccaccctt

SEQ ID NO: 1118 - DNA, 20 bp, Artificial Sequence
  Description of Artificial Sequence: Synthetic oligonucleotide
ctgattagttcctggtcccc

SEQ ID NO: 1119 - DNA, 19 bp, Artificial Sequence
  Description of Artificial Sequence: Synthetic oligonucleotide
atgtgcctttcaactctca

SEQ ID NO: 1120 - DNA, 24 bp, Artificial Sequence
  Description of Artificial Sequence: Synthetic oligonucleotide
ccttcttctttttgtcctttttag

SEQ ID NO: 1121 - DNA, 16 bp, Artificial Sequence
  Description of Artificial Sequence: Synthetic oligonucleotide
ttgccagccattctag

SEQ ID NO: 1122 - DNA, 19 bp, Artificial Sequence
  Description of Artificial Sequence: Synthetic oligonucleotide
tcagcgttcttcggaatgt

SEQ ID NO: 1123 - DNA, 21 bp, Artificial Sequence
  Description of Artificial Sequence: Synthetic oligonucleotide
cccagttcctaggtagtagaa

SEQ ID NO: 1124 - DNA, 24 bp, Artificial Sequence
  Description of Artificial Sequence: Synthetic oligonucleotide
aagataacccacataataagctgc

SEQ ID NO: 1125 - DNA, 17 bp, Artificial Sequence
  Description of Artificial Sequence: Synthetic oligonucleotide
cacgtgtgaaagaatta

SEQ ID NO: 1126 - DNA, 22 bp, Artificial Sequence
  Description of Artificial Sequence: Synthetic oligonucleotide
tatgtaaagcaagtaaagtttg

SEQ ID NO: 1127 - DNA, 16 bp, Artificial Sequence
  Description of Artificial Sequence: Synthetic oligonucleotide
cccactgcgttctcca

SEQ ID NO: 1128 - DNA, 19 bp, Artificial Sequence
  Description of Artificial Sequence: Synthetic oligonucleotide
tctgtgaatttcaattttg

SEQ ID NO: 1129 - DNA, 20 bp, Artificial Sequence
  Description of Artificial Sequence: Synthetic oligonucleotide
aagtgtacgttgaaatcctt

SEQ ID NO: 1130 - DNA, 24 bp, Artificial Sequence
  Description of Artificial Sequence: Synthetic oligonucleotide
tcaacctaggacttttctattaaa

SEQ ID NO: 1131 - DNA, 19 bp, Artificial Sequence
  Description of Artificial Sequence: Synthetic oligonucleotide
tacacaggtgccatcaaat

SEQ ID NO: 1132 - DNA, 18 bp, Artificial Sequence
  Description of Artificial Sequence: Synthetic oligonucleotide
acctgagcatagtcttgc

SEQ ID NO: 1133 - DNA, 19 bp, Artificial Sequence
  Description of Artificial Sequence: Synthetic oligonucleotide
acattccccattgaaggtg

SEQ ID NO: 1134 - DNA, 18 bp, Artificial Sequence
  Description of Artificial Sequence: Synthetic oligonucleotide
tcaagctggttcaatctg

SEQ ID NO: 1135 - DNA, 18 bp, Artificial Sequence
  Description of Artificial Sequence: Synthetic oligonucleotide
ctgaggatctgaaaactt

SEQ ID NO: 1136 - DNA, 17 bp, Artificial Sequence
  Description of Artificial Sequence: Synthetic oligonucleotide
ctgcgtcttggttcacc

SEQ ID NO: 1137 - DNA, 21 bp, Artificial Sequence
  Description of Artificial Sequence: Synthetic oligonucleotide
ttgcacaatttgcccccagcg

SEQ ID NO: 1138 - DNA, 17 bp, Artificial Sequence
  Description of Artificial Sequence: Synthetic oligonucleotide
tttttgccgaggcttct

SEQ ID NO: 1139 - DNA, 18 bp, Artificial Sequence
  Description of Artificial Sequence: Synthetic oligonucleotide
accctctctcagaaacaa

SEQ ID NO: 1140 - DNA, 19 bp, Artificial Sequence
  Description of Artificial Sequence: Synthetic oligonucleotide
ttgccgaggcttcttagaa

SEQ ID NO: 1141 - DNA, 21 bp, Artificial Sequence
  Description of Artificial Sequence: Synthetic oligonucleotide
atccaatttgatggcacctgt

SEQ ID NO: 1142 - DNA, 19 bp, Artificial Sequence
  Description of Artificial Sequence: Synthetic oligonucleotide
aacaaacccaaggaaattt

SEQ ID NO: 1143 - DNA, 19 bp, Artificial Sequence
  Description of Artificial Sequence: Synthetic oligonucleotide
aatacctattggcaaatct

SEQ ID NO: 1144 - DNA, 19 bp, Artificial Sequence
  Description of Artificial Sequence: Synthetic oligonucleotide
ccacaatgatcacacttca

SEQ ID NO: 1145 - DNA, 20 bp, Artificial Sequence
  Description of Artificial Sequence: Synthetic oligonucleotide
cccaataggcacacttgtta

SEQ ID NO: 1146 - DNA, 18 bp, Artificial Sequence
  Description of Artificial Sequence: Synthetic oligonucleotide
taccctgacaaagttttc

SEQ ID NO: 1147 - DNA, 19 bp, Artificial Sequence
  Description of Artificial Sequence: Synthetic oligonucleotide
ttgtggcactgagaatttg

SEQ ID NO: 1148 - DNA, 15 bp, Artificial Sequence
  Description of Artificial Sequence: Synthetic oligonucleotide
ccatgccaatgcgcg

SEQ ID NO: 1149 - DNA, 20 bp, Artificial Sequence
  Description of Artificial Sequence: Synthetic oligonucleotide
attcaaaagtgcaattattc

SEQ ID NO: 1150 - DNA, 19 bp, Artificial Sequence
  Description of Artificial Sequence: Synthetic oligonucleotide
ctgttttccttcaaggtcc

SEQ ID NO: 1151 - DNA, 17 bp, Artificial Sequence
  Description of Artificial Sequence: Synthetic oligonucleotide
ctgctgcttgacagatt

SEQ ID NO: 1152 - DNA, 17 bp, Artificial Sequence
  Description of Artificial Sequence: Synthetic oligonucleotide
acgtggtccagaacaaa

SEQ ID NO: 1153 - DNA, 20 bp, Artificial Sequence
  Description of Artificial Sequence: Synthetic oligonucleotide
cttcaacctaggacttttct

SEQ ID NO: 1154 - DNA, 19 bp, Artificial Sequence
  Description of Artificial Sequence: Synthetic oligonucleotide
atgaatgcaaccaaatgtg

SEQ ID NO: 1155 - DNA, 15 bp, Artificial Sequence
  Description of Artificial Sequence: Synthetic oligonucleotide
cagtgccacaaaatt

SEQ ID NO: 1156 - DNA, 19 bp, Artificial Sequence
  Description of Artificial Sequence: Synthetic oligonucleotide
cacttgttatggcaaccaa

SEQ ID NO: 1157 - DNA, 18 bp, Artificial Sequence
  Description of Artificial Sequence: Synthetic oligonucleotide
acattgccaaaaggcttc

SEQ ID NO: 1158 - DNA, 19 bp, Artificial Sequence
  Description of Artificial Sequence: Synthetic oligonucleotide
aaggctgagagacatattc

SEQ ID NO: 1159 - DNA, 18 bp, Artificial Sequence
  Description of Artificial Sequence: Synthetic oligonucleotide
ccctgtcctaccatttaa

SEQ ID NO: 1160 - DNA, 17 bp, Artificial Sequence
  Description of Artificial Sequence: Synthetic oligonucleotide
ctagtgcgaataattgc

SEQ ID NO: 1161 - DNA, 19 bp, Artificial Sequence
  Description of Artificial Sequence: Synthetic oligonucleotide
taagcacacgcctattaat

SEQ ID NO: 1162 - DNA, 19 bp, Artificial Sequence
  Description of Artificial Sequence: Synthetic oligonucleotide
acccataaagccatcaagc

SEQ ID NO: 1163 - DNA, 18 bp, Artificial Sequence
  Description of Artificial Sequence: Synthetic oligonucleotide
caagtagtggcaccttct

SEQ ID NO: 1164 - DNA, 19 bp, Artificial Sequence
  Description of Artificial Sequence: Synthetic oligonucleotide
aaactgtcactaagaaatc

SEQ ID NO: 1165 - DNA, 19 bp, Artificial Sequence
  Description of Artificial Sequence: Synthetic oligonucleotide
ctgcgttctccattctggt

SEQ ID NO: 1166 - DNA, 18 bp, Artificial Sequence
  Description of Artificial Sequence: Synthetic oligonucleotide
atgctgttgttaaaattt

SEQ ID NO: 1167 - DNA, 16 bp, Artificial Sequence
  Description of Artificial Sequence: Synthetic oligonucleotide
attggcacccgcaatc

SEQ ID NO: 1168 - DNA, 17 bp, Artificial Sequence
  Description of Artificial Sequence: Synthetic oligonucleotide
cccgcaatcctgctaac

SEQ ID NO: 1169 - DNA, 16 bp, Artificial Sequence
  Description of Artificial Sequence: Synthetic oligonucleotide
cagcagcagatttctt

SEQ ID NO: 1170 - DNA, 20 bp, Artificial Sequence
  Description of Artificial Sequence: Synthetic oligonucleotide
tttgtatgcgtcaatatgct

SEQ ID NO: 1171 - DNA, 23 bp, Artificial Sequence
  Description of Artificial Sequence: Synthetic oligonucleotide
ctgcagcttattatgtgggttat

SEQ ID NO: 1172 - DNA, 19 bp, Artificial Sequence
  Description of Artificial Sequence: Synthetic oligonucleotide
aactctgaactcactttcc

SEQ ID NO: 1173 - DNA, 17 bp, Artificial Sequence
  Description of Artificial Sequence: Synthetic oligonucleotide
ccagttgcgtcaccaaa

SEQ ID NO: 1174 - DNA, 17 bp, Artificial Sequence
  Description of Artificial Sequence: Synthetic oligonucleotide
aagccacttgcgaattt

SEQ ID NO: 1175 - DNA, 17 bp, Artificial Sequence
  Description of Artificial Sequence: Synthetic oligonucleotide
aacaaggccaaactgtc

SEQ ID NO: 1176 - DNA, 18 bp, Artificial Sequence
  Description of Artificial Sequence: Synthetic oligonucleotide
atcctgctaacaatgctg

SEQ ID NO: 1177 - DNA, 20 bp, Artificial Sequence
  Description of Artificial Sequence: Synthetic oligonucleotide
aaactgaggatctgaaaact

SEQ ID NO: 1178 - DNA, 19 bp, Artificial Sequence
  Description of Artificial Sequence: Synthetic oligonucleotide
ctgttggtgggaatgtttt

SEQ ID NO: 1179 - DNA, 21 bp, Artificial Sequence
  Description of Artificial Sequence: Synthetic oligonucleotide
cagcttattatgtgggttatc

SEQ ID NO: 1180 - DNA, 20 bp, Artificial Sequence
  Description of Artificial Sequence: Synthetic oligonucleotide
ccaagtaacattggaaaaga

SEQ ID NO: 1181 - DNA, 19 bp, Artificial Sequence
  Description of Artificial Sequence: Synthetic oligonucleotide
ccagatgaccaaattggct

SEQ ID NO: 1182 - DNA, 18 bp, Artificial Sequence
  Description of Artificial Sequence: Synthetic oligonucleotide
ccttaccgcagagacaga

SEQ ID NO: 1183 - DNA, 17 bp, Artificial Sequence
  Description of Artificial Sequence: Synthetic oligonucleotide
accagctgtccaacctg

SEQ ID NO: 1184 - DNA, 20 bp, Artificial Sequence
  Description of Artificial Sequence: Synthetic oligonucleotide
caaggtttacccaataatac

SEQ ID NO: 1185 - DNA, 19 bp, Artificial Sequence
  Description of Artificial Sequence: Synthetic oligonucleotide
aaggcgttccaattaacac

SEQ ID NO: 1186 - DNA, 18 bp, Artificial Sequence
  Description of Artificial Sequence: Synthetic oligonucleotide
cctttaccagacattttg

SEQ ID NO: 1187 - DNA, 21 bp, Artificial Sequence
  Description of Artificial Sequence: Synthetic oligonucleotide
tcagccttcttctttttgtcc

SEQ ID NO: 1188 - DNA, 19 bp, Artificial Sequence
  Description of Artificial Sequence: Synthetic oligonucleotide
cctactgctgcctggagtt

SEQ ID NO: 1189 - DNA, 20 bp, Artificial Sequence
  Description of Artificial Sequence: Synthetic oligonucleotide
catcacgtagtcgcaacagt

SEQ ID NO: 1190 - DNA, 20 bp, Artificial Sequence
  Description of Artificial Sequence: Synthetic oligonucleotide
ttctcagtggaagcaaaata

SEQ ID NO: 1191 - DNA, 21 bp, Artificial Sequence
  Description of Artificial Sequence: Synthetic oligonucleotide
acatcactaggtttcaaactt

SEQ ID NO: 1192 - DNA, 17 bp, Artificial Sequence
  Description of Artificial Sequence: Synthetic oligonucleotide
ccagatgaccaaattgg

SEQ ID NO: 1193 - DNA, 18 bp, Artificial Sequence
  Description of Artificial Sequence: Synthetic oligonucleotide
atcacgcactaaattaat

SEQ ID NO: 1194 - DNA, 18 bp, Artificial Sequence
  Description of Artificial Sequence: Synthetic oligonucleotide
acttaccccaaaatgctg

SEQ ID NO: 1195 - DNA, 15 bp, Artificial Sequence
  Description of Artificial Sequence: Synthetic oligonucleotide
ttgccgaggcttctt

SEQ ID NO: 1196 - DNA, 18 bp, Artificial Sequence
  Description of Artificial Sequence: Synthetic oligonucleotide
caatttgcccccagcgct

SEQ ID NO: 1197 - DNA, 17 bp, Artificial Sequence
  Description of Artificial Sequence: Synthetic oligonucleotide
tctagcaggagaagttc

SEQ ID NO: 1198 - DNA, 22 bp, Artificial Sequence
  Description of Artificial Sequence: Synthetic oligonucleotide
actactttagattcgaagaccc

SEQ ID NO: 1199 - DNA, 19 bp, Artificial Sequence
  Description of Artificial Sequence: Synthetic oligonucleotide
aagtgtacgttgaaatcct

SEQ ID NO: 1200 - DNA, 20 bp, Artificial Sequence
  Description of Artificial Sequence: Synthetic oligonucleotide
cccagtccctacttattgtt

SEQ ID NO: 1201 - DNA, 19 bp, Artificial Sequence
  Description of Artificial Sequence: Synthetic oligonucleotide
aaatgctgttgttaaaatt

SEQ ID NO: 1202 - DNA, 21 bp, Artificial Sequence
  Description of Artificial Sequence: Synthetic oligonucleotide
ttgagttctggttgtaagatt

SEQ ID NO: 1203 - DNA, 16 bp, Artificial Sequence
  Description of Artificial Sequence: Synthetic oligonucleotide
tcgcgccccactgcgt

SEQ ID NO: 1204 - DNA, 18 bp, Artificial Sequence
  Description of Artificial Sequence: Synthetic oligonucleotide
ttggccgcaaattgcaca

SEQ ID NO: 1205 - DNA, 18 bp, Artificial Sequence
  Description of Artificial Sequence: Synthetic oligonucleotide
tcgtggtggtgacggtaa

SEQ ID NO: 1206 - DNA, 18 bp, Artificial Sequence
  Description of Artificial Sequence: Synthetic oligonucleotide
accaatggttctaaagcc

SEQ ID NO: 1207 - DNA, 18 bp, Artificial Sequence
  Description of Artificial Sequence: Synthetic oligonucleotide
ttgcggccaatgtttgta

SEQ ID NO: 1208 - DNA, 19 bp, Artificial Sequence
  Description of Artificial Sequence: Synthetic oligonucleotide
tacctattggcaaatctac

SEQ ID NO: 1209 - DNA, 20 bp, Artificial Sequence
  Description of Artificial Sequence: Synthetic oligonucleotide
caagtcctgagttgaatgta

SEQ ID NO: 1210 - DNA, 18 bp, Artificial Sequence
  Description of Artificial Sequence: Synthetic oligonucleotide
ctgggtcttcgaatctaa

SEQ ID NO: 1211 - DNA, 17 bp, Artificial Sequence
  Description of Artificial Sequence: Synthetic oligonucleotide
cattgccaaaaggcttc

SEQ ID NO: 1212 - DNA, 18 bp, Artificial Sequence
  Description of Artificial Sequence: Synthetic oligonucleotide
ttcggcaagactatgctc

SEQ ID NO: 1213 - DNA, 19 bp, Artificial Sequence
  Description of Artificial Sequence: Synthetic oligonucleotide
cacaagtagtggcaccttc

SEQ ID NO: 1214 - DNA, 20 bp, Artificial Sequence
  Description of Artificial Sequence: Synthetic oligonucleotide
aatggatcattacaaaattg

SEQ ID NO: 1215 - DNA, 17 bp, Artificial Sequence
  Description of Artificial Sequence: Synthetic oligonucleotide
caaacccaaggaaattt

SEQ ID NO: 1216 - DNA, 20 bp, Artificial Sequence
  Description of Artificial Sequence: Synthetic oligonucleotide
ttgtttttgtggtaataaac

SEQ ID NO: 1217 - DNA, 17 bp, Artificial Sequence
  Description of Artificial Sequence: Synthetic oligonucleotide
cctccaaaggcaatagt

SEQ ID NO: 1218 - DNA, 16 bp, Artificial Sequence
  Description of Artificial Sequence: Synthetic oligonucleotide
ctcgagggaatttaag

SEQ ID NO: 1219 - DNA, 21 bp, Artificial Sequence
  Description of Artificial Sequence: Synthetic oligonucleotide
ctagagactagtggcaataaa

SEQ ID NO: 1220 - DNA, 20 bp, Artificial Sequence
  Description of Artificial Sequence: Synthetic oligonucleotide
atcgtgctacaacttcctca

SEQ ID NO: 1221 - DNA, 18 bp, Artificial Sequence
  Description of Artificial Sequence: Synthetic oligonucleotide
ccgctctcactcaacatg

SEQ ID NO: 1222 - DNA, 20 bp, Artificial Sequence
  Description of Artificial Sequence: Synthetic oligonucleotide
atggtaggacagggttatca

SEQ ID NO: 1223 - DNA, 18 bp, Artificial Sequence
  Description of Artificial Sequence: Synthetic oligonucleotide
ccctatggtgctaacaaa

SEQ ID NO: 1224 - DNA, 18 bp, Artificial Sequence
  Description of Artificial Sequence: Synthetic oligonucleotide
attggatgacaaagatcc

SEQ ID NO: 1225 - DNA, 19 bp, Artificial Sequence
  Description of Artificial Sequence: Synthetic oligonucleotide
aactgaggatctgaaaact

SEQ ID NO: 1226 - DNA, 20 bp, Artificial Sequence
  Description of Artificial Sequence: Synthetic oligonucleotide
ctgggtcttcgaatctaaag

SEQ ID NO: 1227 - DNA, 18 bp, Artificial Sequence
  Description of Artificial Sequence: Synthetic oligonucleotide
cccctgcatacactaatt

SEQ ID NO: 1228 - DNA, 18 bp, Artificial Sequence
  Description of Artificial Sequence: Synthetic oligonucleotide
cctaggttgaagataacc

SEQ ID NO: 1229 - DNA, 17 bp, Artificial Sequence
  Description of Artificial Sequence: Synthetic oligonucleotide
ctctgctcccttctgcg

SEQ ID NO: 1230 - DNA, 21 bp, Artificial Sequence
  Description of Artificial Sequence: Synthetic oligonucleotide
cctcttctcgttcctcatcac

SEQ ID NO: 1231 - DNA, 21 bp, Artificial Sequence
  Description of Artificial Sequence: Synthetic oligonucleotide
cctgtatggttacaacctatg

SEQ ID NO: 1232 - DNA, 21 bp, Artificial Sequence
  Description of Artificial Sequence: Synthetic oligonucleotide
caaaagatcacattggcaccc

SEQ ID NO: 1233 - DNA, 19 bp, Artificial Sequence
  Description of Artificial Sequence: Synthetic oligonucleotide
acgcaactggatagacaga

SEQ ID NO: 1234 - DNA, 20 bp, Artificial Sequence
  Description of Artificial Sequence: Synthetic oligonucleotide
cttccttgccatgttgagtg

SEQ ID NO: 1235 - DNA, 17 bp, Artificial Sequence
  Description of Artificial Sequence: Synthetic oligonucleotide
ctgctcatggattgttg

SEQ ID NO: 1236 - DNA, 21 bp, Artificial Sequence
  Description of Artificial Sequence: Synthetic oligonucleotide
aaggctgagagacatattcaa

SEQ ID NO: 1237 - DNA, 25 bp, Artificial Sequence
  Description of Artificial Sequence: Synthetic oligonucleotide
cctaggacttttctattaaaatata

SEQ ID NO: 1238 - DNA, 19 bp, Artificial Sequence
  Description of Artificial Sequence: Synthetic oligonucleotide
cattggcatggaagtcaca

SEQ ID NO: 1239 - DNA, 20 bp, Artificial Sequence
  Description of Artificial Sequence: Synthetic oligonucleotide
taccgtcaccaccacgaatt

SEQ ID NO: 1240 - DNA, 21 bp, Artificial Sequence
  Description of Artificial Sequence: Synthetic oligonucleotide
cagtccaagatggtatttcta

SEQ ID NO: 1241 - DNA, 22 bp, Artificial Sequence
  Description of Artificial Sequence: Synthetic oligonucleotide
aaaatggatcattacaaaattg

SEQ ID NO: 1242 - DNA, 20 bp, Artificial Sequence
  Description of Artificial Sequence: Synthetic oligonucleotide
atgctggacaataaatttta

SEQ ID NO: 1243 - DNA, 16 bp, Artificial Sequence
  Description of Artificial Sequence: Synthetic oligonucleotide
ttggcaaagaaatttg

SEQ ID NO: 1244 - DNA, 18 bp, Artificial Sequence
  Description of Artificial Sequence: Synthetic oligonucleotide
acgtggtgtttattaccc

SEQ ID NO: 1245 - DNA, 18 bp, Artificial Sequence
  Description of Artificial Sequence: Synthetic oligonucleotide
ttgatcgcgccccactgc

SEQ ID NO: 1246 - DNA, 20 bp, Artificial Sequence
  Description of Artificial Sequence: Synthetic oligonucleotide
tcgcactagaataaactctg

SEQ ID NO: 1247 - DNA, 19 bp, Artificial Sequence
  Description of Artificial Sequence: Synthetic oligonucleotide
cagtccagatgaccaaatt

SEQ ID NO: 1248 - DNA, 17 bp, Artificial Sequence
  Description of Artificial Sequence: Synthetic oligonucleotide
ctcctggtgattcttct

SEQ ID NO: 1249 - DNA, 17 bp, Artificial Sequence
  Description of Artificial Sequence: Synthetic oligonucleotide
tcggccccaaggtttac

SEQ ID NO: 1250 - DNA, 19 bp, Artificial Sequence
  Description of Artificial Sequence: Synthetic oligonucleotide
aagggaaatacaaaatttg

SEQ ID NO: 1251 - DNA, 18 bp, Artificial Sequence
  Description of Artificial Sequence: Synthetic oligonucleotide
caggtgccatcaaattgg

SEQ ID NO: 1252 - DNA, 17 bp, Artificial Sequence
  Description of Artificial Sequence: Synthetic oligonucleotide
ctgtgcacttgaccctc

SEQ ID NO: 1253 - DNA, 18 bp, Artificial Sequence
  Description of Artificial Sequence: Synthetic oligonucleotide
taggtcaaccacgttccc

SEQ ID NO: 1254 - DNA, 21 bp, Artificial Sequence
  Description of Artificial Sequence: Synthetic oligonucleotide
cataataagaggctggatttt

SEQ ID NO: 1255 - DNA, 17 bp, Artificial Sequence
  Description of Artificial Sequence: Synthetic oligonucleotide
ttgactgccgcctctgc

SEQ ID NO: 1256 - DNA, 19 bp, Artificial Sequence
  Description of Artificial Sequence: Synthetic oligonucleotide
acaatttgcccccagcgct

SEQ ID NO: 1257 - DNA, 16 bp, Artificial Sequence
  Description of Artificial Sequence: Synthetic oligonucleotide
aaacccaaggaaattt

SEQ ID NO: 1258 - DNA, 19 bp, Artificial Sequence
  Description of Artificial Sequence: Synthetic oligonucleotide
aacgtactgccactaaagc

SEQ ID NO: 1259 - DNA, 22 bp, Artificial Sequence
  Description of Artificial Sequence: Synthetic oligonucleotide
ctagtcagtgtgttaatcttac

SEQ ID NO: 1260 - DNA, 20 bp, Artificial Sequence
  Description of Artificial Sequence: Synthetic oligonucleotide
ccaacaacacctgtatggtt

SEQ ID NO: 1261 - DNA, 19 bp, Artificial Sequence
  Description of Artificial Sequence: Synthetic oligonucleotide
aaggctccctcagttgcaa

SEQ ID NO: 1262 - DNA, 20 bp, Artificial Sequence
  Description of Artificial Sequence: Synthetic oligonucleotide
tacaaccagaactcaattac

SEQ ID NO: 1263 - DNA, 20 bp, Artificial Sequence
  Description of Artificial Sequence: Synthetic oligonucleotide
ttgggttccacgtgctagcg

SEQ ID NO: 1264 - DNA, 21 bp, Artificial Sequence
  Description of Artificial Sequence: Synthetic oligonucleotide
ctgtaatggttccattttcat

SEQ ID NO: 1265 - DNA, 20 bp, Artificial Sequence
  Description of Artificial Sequence: Synthetic oligonucleotide
ttgcggccaatgtttgtaat

SEQ ID NO: 1266 - DNA, 20 bp, Artificial Sequence
  Description of Artificial Sequence: Synthetic oligonucleotide
aatgaatctggcttgaaaac

SEQ ID NO: 1267 - DNA, 17 bp, Artificial Sequence
  Description of Artificial Sequence: Synthetic oligonucleotide
atgcgcgacattccgaa

SEQ ID NO: 1268 - DNA, 16 bp, Artificial Sequence
  Description of Artificial Sequence: Synthetic oligonucleotide
cctggagttgaatttc

SEQ ID NO: 1269 - DNA, 18 bp, Artificial Sequence
  Description of Artificial Sequence: Synthetic oligonucleotide
ttgcgtcaccaaatgaat

SEQ ID NO: 1270 - DNA, 19 bp, Artificial Sequence
  Description of Artificial Sequence: Synthetic oligonucleotide
acctattggcaaatctacc

SEQ ID NO: 1271 - DNA, 21 bp, Artificial Sequence
  Description of Artificial Sequence: Synthetic oligonucleotide
atgtaaagcaagtaaagtttg

SEQ ID NO: 1272 - DNA, 18 bp, Artificial Sequence
  Description of Artificial Sequence: Synthetic oligonucleotide
acgcatacaaaacattcc

SEQ ID NO: 1273 - DNA, 16 bp, Artificial Sequence
  Description of Artificial Sequence: Synthetic oligonucleotide
tcctgctgcagatttg

SEQ ID NO: 1274 - DNA, 19 bp, Artificial Sequence
  Description of Artificial Sequence: Synthetic oligonucleotide
atagtcttgccgaatacca

SEQ ID NO: 1275 - DNA, 19 bp, Artificial Sequence
  Description of Artificial Sequence: Synthetic oligonucleotide
cagacgggcgattttgtta

SEQ ID NO: 1276 - DNA, 24 bp, Artificial Sequence
  Description of Artificial Sequence: Synthetic oligonucleotide
cttgctttacatagaagttatttg

SEQ ID NO: 1277 - DNA, 17 bp, Artificial Sequence
  Description of Artificial Sequence: Synthetic oligonucleotide
cagtggaagcaaaataa

SEQ ID NO: 1278 - DNA, 20 bp, Artificial Sequence
  Description of Artificial Sequence: Synthetic oligonucleotide
aaaggcaatagtgcgaccac

SEQ ID NO: 1279 - DNA, 23 bp, Artificial Sequence
  Description of Artificial Sequence: Synthetic oligonucleotide
ctgtgactcttcttcctgctgca

SEQ ID NO: 1280 - DNA, 19 bp, Artificial Sequence
  Description of Artificial Sequence: Synthetic oligonucleotide
caagcctcttctcgttcct

SEQ ID NO: 1281 - DNA, 20 bp, Artificial Sequence
  Description of Artificial Sequence: Synthetic oligonucleotide
ttggtgacgcaactggatag

SEQ ID NO: 1282 - DNA, 21 bp, Artificial Sequence
  Description of Artificial Sequence: Synthetic oligonucleotide
acacactgactagagactagt

SEQ ID NO: 1283 - DNA, 20 bp, Artificial Sequence
  Description of Artificial Sequence: Synthetic oligonucleotide
caattaccccctgcatacac

SEQ ID NO: 1284 - DNA, 19 bp, Artificial Sequence
  Description of Artificial Sequence: Synthetic oligonucleotide
ttgcggccaatgtttgtaa

SEQ ID NO: 1285 - DNA, 19 bp, Artificial Sequence
  Description of Artificial Sequence: Synthetic oligonucleotide
ttactgccagttgaatctg

SEQ ID NO: 1286 - DNA, 20 bp, Artificial Sequence
  Description of Artificial Sequence: Synthetic oligonucleotide
aaccctgtcctaccatttaa

SEQ ID NO: 1287 - DNA, 21 bp, Artificial Sequence
  Description of Artificial Sequence: Synthetic oligonucleotide
tattcttaaacacaaattccc

SEQ ID NO: 1288 - DNA, 20 bp, Artificial Sequence
  Description of Artificial Sequence: Synthetic oligonucleotide
cttgaccctctctcagaaac

SEQ ID NO: 1289 - DNA, 18 bp, Artificial Sequence
  Description of Artificial Sequence: Synthetic oligonucleotide
cattcccaccaacagagc

SEQ ID NO: 1290 - DNA, 19 bp, Artificial Sequence
  Description of Artificial Sequence: Synthetic oligonucleotide
ctggcagtaaccagaatgg

SEQ ID NO: 1291 - DNA, 14 bp, Artificial Sequence
  Description of Artificial Sequence: Synthetic oligonucleotide
acccgcaatcctgc

SEQ ID NO: 1292 - DNA, 16 bp, Artificial Sequence
  Description of Artificial Sequence: Synthetic oligonucleotide
ccgcctctgctccctt

SEQ ID NO: 1293 - DNA, 22 bp, Artificial Sequence
  Description of Artificial Sequence: Synthetic oligonucleotide
taggcgtgtgcttagaatatat

SEQ ID NO: 1294 - DNA, 15 bp, Artificial Sequence
  Description of Artificial Sequence: Synthetic oligonucleotide
ccacttgcgaatttt

SEQ ID NO: 1295 - DNA, 18 bp, Artificial Sequence
  Description of Artificial Sequence: Synthetic oligonucleotide
ctttccatccaacttttg

SEQ ID NO: 1296 - DNA, 29 bp, Artificial Sequence
  Description of Artificial Sequence: Synthetic oligonucleotide
ctgagctttcatggccttctgctatttca

SEQ ID NO: 1297 - DNA, 18 bp, Artificial Sequence
  Description of Artificial Sequence: Synthetic oligonucleotide
actgggcacggtgagcgt

SEQ ID NO: 1298 - DNA, 28 bp, Artificial Sequence
  Description of Artificial Sequence: Synthetic oligonucleotide
tctggagccacctctcccatttctttta

SEQ ID NO: 1299 - DNA, 27 bp, Artificial Sequence
  Description of Artificial Sequence: Synthetic oligonucleotide
acaagcttcacgaaggctccacataca

SEQ ID NO: 1300 - DNA, 24 bp, Artificial Sequence
  Description of Artificial Sequence: Synthetic oligonucleotide
atccattcagcgaccccgttagcg

SEQ ID NO: 1301 - DNA, 26 bp, Artificial Sequence
  Description of Artificial Sequence: Synthetic oligonucleotide
aaatagcagaaggccatgaaagctca

SEQ ID NO: 1302 - DNA, 30 bp, Artificial Sequence
  Description of Artificial Sequence: Synthetic oligonucleotide
aaatagcagaaggccatgaaagctcagcgc

SEQ ID NO: 1303 - DNA, 34 bp, Artificial Sequence
  Description of Artificial Sequence: Synthetic oligonucleotide
aaatagcagaaggccatgaaagctcagcgctact

SEQ ID NO: 1304 - DNA, 38 bp, Artificial Sequence
  Description of Artificial Sequence: Synthetic oligonucleotide
aaatagcagaaggccatgaaagctcagcgctactatat

SEQ ID NO: 1305 - DNA, 33 bp, Artificial Sequence
  Description of Artificial Sequence: Synthetic oligonucleotide
aagcatttgaaatagcagaaggccatgaaagct

SEQ ID NO: 1306 - DNA, 37 bp, Artificial Sequence
  Description of Artificial Sequence: Synthetic oligonucleotide
aagcatttgaaatagcagaaggccatgaaagctcagc

SEQ ID NO: 1307 - DNA, 16 bp, Artificial Sequence
  Description of Artificial Sequence: Synthetic oligonucleotide
aaggccatgaaagctc

SEQ ID NO: 1308 - DNA, 20 bp, Artificial Sequence
  Description of Artificial Sequence: Synthetic oligonucleotide
aaggccatgaaagctcagcg

SEQ ID NO: 1309 - DNA, 24 bp, Artificial Sequence
  Description of Artificial Sequence: Synthetic oligonucleotide
aaggccatgaaagctcagcgctac

SEQ ID NO: 1310 - DNA, 28 bp, Artificial Sequence
  Description of Artificial Sequence: Synthetic oligonucleotide
aaggccatgaaagctcagcgctactata

SEQ ID NO: 1311 - DNA, 32 bp, Artificial Sequence
  Description of Artificial Sequence: Synthetic oligonucleotide
aaggccatgaaagctcagcgctactatattgt

SEQ ID NO: 1312 - DNA, 36 bp, Artificial Sequence
  Description of Artificial Sequence: Synthetic oligonucleotide
aaggccatgaaagctcagcgctactatattgtctca

SEQ ID NO: 1313 - DNA, 40 bp, Artificial Sequence
  Description of Artificial Sequence: Synthetic oligonucleotide
aaggccatgaaagctcagcgctactatattgtctcatggt

SEQ ID NO: 1314 - DNA, 25 bp, Artificial Sequence
  Description of Artificial Sequence: Synthetic oligonucleotide
aatagcagaaggccatgaaagctca

SEQ ID NO: 1315 - DNA, 29 bp, Artificial Sequence
  Description of Artificial Sequence: Synthetic oligonucleotide
aatagcagaaggccatgaaagctcagcgc

SEQ ID NO: 1316 - DNA, 33 bp, Artificial Sequence
  Description of Artificial Sequence: Synthetic oligonucleotide
aatagcagaaggccatgaaagctcagcgctact

SEQ ID NO: 1317 - DNA, 37 bp, Artificial Sequence
  Description of Artificial Sequence: Synthetic oligonucleotide
aatagcagaaggccatgaaagctcagcgctactatat

SEQ ID NO: 1318 - DNA, 27 bp, Artificial Sequence
  Description of Artificial Sequence: Synthetic oligonucleotide
aatatagtagcgctgagctttcatggc

SEQ ID NO: 1319 - DNA, 31 bp, Artificial Sequence
  Description of Artificial Sequence: Synthetic oligonucleotide
aatatagtagcgctgagctttcatggccttc

SEQ ID NO: 1320 - DNA, 35 bp, Artificial Sequence
  Description of Artificial Sequence: Synthetic oligonucleotide
aatatagtagcgctgagctttcatggccttctgct

SEQ ID NO: 1321 - DNA, 39 bp, Artificial Sequence
  Description of Artificial Sequence: Synthetic oligonucleotide
aatatagtagcgctgagctttcatggccttctgctattt

SEQ ID NO: 1322 - DNA, 30 bp, Artificial Sequence
  Description of Artificial Sequence: Synthetic oligonucleotide
acaatatagtagcgctgagctttcatggcc

SEQ ID NO: 1323 - DNA, 34 bp, Artificial Sequence
  Description of Artificial Sequence: Synthetic oligonucleotide
acaatatagtagcgctgagctttcatggccttct

SEQ ID NO: 1324 - DNA, 38 bp, Artificial Sequence
  Description of Artificial Sequence: Synthetic oligonucleotide
acaatatagtagcgctgagctttcatggccttctgcta

SEQ ID NO: 1325 - DNA, 37 bp, Artificial Sequence
  Description of Artificial Sequence: Synthetic oligonucleotide
accatgagacaatatagtagcgctgagctttcatggc

SEQ ID NO: 1326 - DNA, 16 bp, Artificial Sequence
  Description of Artificial Sequence: Synthetic oligonucleotide
agaaggccatgaaagc

SEQ ID NO: 1327 - DNA, 20 bp, Artificial Sequence
  Description of Artificial Sequence: Synthetic oligonucleotide
agaaggccatgaaagctcag

SEQ ID NO: 1328 - DNA, 24 bp, Artificial Sequence
  Description of Artificial Sequence: Synthetic oligonucleotide
agaaggccatgaaagctcagcgct

SEQ ID NO: 1329 - DNA, 28 bp, Artificial Sequence
  Description of Artificial Sequence: Synthetic oligonucleotide
agaaggccatgaaagctcagcgctacta

SEQ ID NO: 1330 - DNA, 32 bp, Artificial Sequence
  Description of Artificial Sequence: Synthetic oligonucleotide
agaaggccatgaaagctcagcgctactatatt

SEQ ID NO: 1331 - DNA, 36 bp, Artificial Sequence
  Description of Artificial Sequence: Synthetic oligonucleotide
agaaggccatgaaagctcagcgctactatattgtct

SEQ ID NO: 1332 - DNA, 40 bp, Artificial Sequence
  Description of Artificial Sequence: Synthetic oligonucleotide
agaaggccatgaaagctcagcgctactatattgtctcatg

SEQ ID NO: 1333 - DNA, 33 bp, Artificial Sequence
  Description of Artificial Sequence: Synthetic oligonucleotide
agacaatatagtagcgctgagctttcatggcct

SEQ ID NO: 1334 - DNA, 37 bp, Artificial Sequence
  Description of Artificial Sequence: Synthetic oligonucleotide
agacaatatagtagcgctgagctttcatggccttctg

SEQ ID NO: 1335 - DNA, 19 bp, Artificial Sequence
  Description of Artificial Sequence: Synthetic oligonucleotide
agcagaaggccatgaaagc

SEQ ID NO: 1336 - DNA, 23 bp, Artificial Sequence
  Description of Artificial Sequence: Synthetic oligonucleotide
agcagaaggccatgaaagctcag

SEQ ID NO: 1337 - DNA, 27 bp, Artificial Sequence
  Description of Artificial Sequence: Synthetic oligonucleotide
agcagaaggccatgaaagctcagcgct

SEQ ID NO: 1338 - DNA, 31 bp, Artificial Sequence
  Description of Artificial Sequence: Synthetic oligonucleotide
agcagaaggccatgaaagctcagcgctacta

SEQ ID NO: 1339 - DNA, 35 bp, Artificial Sequence
  Description of Artificial Sequence: Synthetic oligonucleotide
agcagaaggccatgaaagctcagcgctactatatt

SEQ ID NO: 1340 - DNA, 33 bp, Artificial Sequence
  Description of Artificial Sequence: Synthetic oligonucleotide
agcatttgaaatagcagaaggccatgaaagctc

SEQ ID NO: 1341 - DNA, 37 bp, Artificial Sequence
  Description of Artificial Sequence: Synthetic oligonucleotide
agcatttgaaatagcagaaggccatgaaagctcagcg

SEQ ID NO: 1342 - DNA, 21 bp, Artificial Sequence
  Description of Artificial Sequence: Synthetic oligonucleotide
agcgctgagctttcatggcct

SEQ ID NO: 1343 - DNA, 25 bp, Artificial Sequence
  Description of Artificial Sequence: Synthetic oligonucleotide
agcgctgagctttcatggccttctg

SEQ ID NO: 1344 - DNA, 29 bp, Artificial Sequence
  Description of Artificial Sequence: Synthetic oligonucleotide
agcgctgagctttcatggccttctgctat

SEQ ID NO: 1345 - DNA, 33 bp, Artificial Sequence
  Description of Artificial Sequence: Synthetic oligonucleotide
agcgctgagctttcatggccttctgctatttca

SEQ ID NO: 1346 - DNA, 12 bp, Artificial Sequence
  Description of Artificial Sequence: Synthetic oligonucleotide
agctttcatggc

SEQ ID NO: 1347 - DNA, 16 bp, Artificial Sequence
  Description of Artificial Sequence: Synthetic oligonucleotide
agctttcatggccttc

SEQ ID NO: 1348 - DNA, 20 bp, Artificial Sequence
  Description of Artificial Sequence: Synthetic oligonucleotide
agctttcatggccttctgct

SEQ ID NO: 1349 - DNA, 24 bp, Artificial Sequence
  Description of Artificial Sequence: Synthetic oligonucleotide
agctttcatggccttctgctattt

SEQ ID NO: 1350 - DNA, 28 bp, Artificial Sequence
  Description of Artificial Sequence: Synthetic oligonucleotide
agctttcatggccttctgctatttcaaa

SEQ ID NO: 1351 - DNA, 32 bp, Artificial Sequence
  Description of Artificial Sequence: Synthetic oligonucleotide
agctttcatggccttctgctatttcaaatgct

SEQ ID NO: 1352 - DNA, 36 bp, Artificial Sequence
  Description of Artificial Sequence: Synthetic oligonucleotide
agctttcatggccttctgctatttcaaatgcttcat

SEQ ID NO: 1353 - DNA, 40 bp, Artificial Sequence
  Description of Artificial Sequence: Synthetic oligonucleotide
agctttcatggccttctgctatttcaaatgcttcatgaaa

SEQ ID NO: 1354 - DNA, 16 bp, Artificial Sequence
  Description of Artificial Sequence: Synthetic oligonucleotide
aggccatgaaagctca

SEQ ID NO: 1355 - DNA, 20 bp, Artificial Sequence
  Description of Artificial Sequence: Synthetic oligonucleotide
aggccatgaaagctcagcgc

SEQ ID NO: 1356 - DNA, 24 bp, Artificial Sequence
  Description of Artificial Sequence: Synthetic oligonucleotide
aggccatgaaagctcagcgctact

SEQ ID NO: 1357 - DNA, 28 bp, Artificial Sequence
  Description of Artificial Sequence: Synthetic oligonucleotide
aggccatgaaagctcagcgctactatat

SEQ ID NO: 1358 - DNA, 32 bp, Artificial Sequence
  Description of Artificial Sequence: Synthetic oligonucleotide
aggccatgaaagctcagcgctactatattgtc

SEQ ID NO: 1359 - DNA, 36 bp, Artificial Sequence
  Description of Artificial Sequence: Synthetic oligonucleotide
aggccatgaaagctcagcgctactatattgtctcat

SEQ ID NO: 1360 - DNA, 22 bp, Artificial Sequence
  Description of Artificial Sequence: Synthetic oligonucleotide
agtagcgctgagctttcatggc

SEQ ID NO: 1361 - DNA, 26 bp, Artificial Sequence
  Description of Artificial Sequence: Synthetic oligonucleotide
agtagcgctgagctttcatggccttc

SEQ ID NO: 1362 - DNA, 30 bp, Artificial Sequence
  Description of Artificial Sequence: Synthetic oligonucleotide
agtagcgctgagctttcatggccttctgct

SEQ ID NO: 1363 - DNA, 34 bp, Artificial Sequence
  Description of Artificial Sequence: Synthetic oligonucleotide
agtagcgctgagctttcatggccttctgctattt

SEQ ID NO: 1364 - DNA, 21 bp, Artificial Sequence
  Description of Artificial Sequence: Synthetic oligonucleotide
atagcagaaggccatgaaagc

SEQ ID NO: 1365 - DNA, 25 bp, Artificial Sequence
  Description of Artificial Sequence: Synthetic oligonucleotide
atagcagaaggccatgaaagctcag

SEQ ID NO: 1366 - DNA, 29 bp, Artificial Sequence
  Description of Artificial Sequence: Synthetic oligonucleotide
atagcagaaggccatgaaagctcagcgct

SEQ ID NO: 1367 - DNA, 33 bp, Artificial Sequence
  Description of Artificial Sequence: Synthetic oligonucleotide
atagcagaaggccatgaaagctcagcgctacta

SEQ ID NO: 1368 - DNA, 37 bp, Artificial Sequence
  Description of Artificial Sequence: Synthetic oligonucleotide
atagcagaaggccatgaaagctcagcgctactatatt

SEQ ID NO: 1369 - DNA, 25 bp, Artificial Sequence
  Description of Artificial Sequence: Synthetic oligonucleotide
atagtagcgctgagctttcatggcc

SEQ ID NO: 1370 - DNA, 29 bp, Artificial Sequence
  Description of Artificial Sequence: Synthetic oligonucleotide
atagtagcgctgagctttcatggccttct

SEQ ID NO: 1371 - DNA, 33 bp, Artificial Sequence
  Description of Artificial Sequence: Synthetic oligonucleotide
atagtagcgctgagctttcatggccttctgcta

SEQ ID NO: 1372 - DNA, 37 bp, Artificial Sequence
  Description of Artificial Sequence: Synthetic oligonucleotide
atagtagcgctgagctttcatggccttctgctatttc

SEQ ID NO: 1373 - DNA, 25 bp, Artificial Sequence
  Description of Artificial Sequence: Synthetic oligonucleotide
atatagtagcgctgagctttcatgg

SEQ ID NO: 1374 - DNA, 29 bp, Artificial Sequence
  Description of Artificial Sequence: Synthetic oligonucleotide
atatagtagcgctgagctttcatggcctt

SEQ ID NO: 1375 - DNA, 33 bp, Artificial Sequence
  Description of Artificial Sequence: Synthetic oligonucleotide
atatagtagcgctgagctttcatggccttctgc

SEQ ID NO: 1376 - DNA, 37 bp, Artificial Sequence
  Description of Artificial Sequence: Synthetic oligonucleotide
atatagtagcgctgagctttcatggccttctgctatt

SEQ ID NO: 1377 - DNA, 35 bp, Artificial Sequence
  Description of Artificial Sequence: Synthetic oligonucleotide
atgaagcatttgaaatagcagaaggccatgaaagc

SEQ ID NO: 1378 - DNA, 39 bp, Artificial Sequence
  Description of Artificial Sequence: Synthetic oligonucleotide
atgaagcatttgaaatagcagaaggccatgaaagctcag

SEQ ID NO: 1379 - DNA, 33 bp, Artificial Sequence
  Description of Artificial Sequence: Synthetic oligonucleotide
atgagacaatatagtagcgctgagctttcatgg

SEQ ID NO: 1380 - DNA, 37 bp, Artificial Sequence
  Description of Artificial Sequence: Synthetic oligonucleotide
atgagacaatatagtagcgctgagctttcatggcctt

SEQ ID NO: 1381 - DNA, 28 bp, Artificial Sequence
  Description of Artificial Sequence: Synthetic oligonucleotide
atttgaaatagcagaaggccatgaaagc

SEQ ID NO: 1382 - DNA, 32 bp, Artificial Sequence
  Description of Artificial Sequence: Synthetic oligonucleotide
atttgaaatagcagaaggccatgaaagctcag

SEQ ID NO: 1383 - DNA, 36 bp, Artificial Sequence
  Description of Artificial Sequence: Synthetic oligonucleotide
atttgaaatagcagaaggccatgaaagctcagcgct

SEQ ID NO: 1384 - DNA, 40 bp, Artificial Sequence
  Description of Artificial Sequence: Synthetic oligonucleotide
atttgaaatagcagaaggccatgaaagctcagcgctacta

SEQ ID NO: 1385 - DNA, 30 bp, Artificial Sequence
  Description of Artificial Sequence: Synthetic oligonucleotide
caatatagtagcgctgagctttcatggcct

SEQ ID NO: 1386 - DNA, 34 bp, Artificial Sequence
  Description of Artificial Sequence: Synthetic oligonucleotide
caatatagtagcgctgagctttcatggccttctg

SEQ ID NO: 1387 - DNA, 38 bp, Artificial Sequence
  Description of Artificial Sequence: Synthetic oligonucleotide
caatatagtagcgctgagctttcatggccttctgctat

SEQ ID NO: 1388 - DNA, 18 bp, Artificial Sequence
  Description of Artificial Sequence: Synthetic oligonucleotide
cagaaggccatgaaagct

SEQ ID NO: 1389 - DNA, 22 bp, Artificial Sequence
  Description of Artificial Sequence: Synthetic oligonucleotide
cagaaggccatgaaagctcagc

SEQ ID NO: 1390 - DNA, 26 bp, Artificial Sequence
  Description of Artificial Sequence: Synthetic oligonucleotide
cagaaggccatgaaagctcagcgcta

SEQ ID NO: 1391 - DNA, 30 bp, Artificial Sequence
  Description of Artificial Sequence: Synthetic oligonucleotide
cagaaggccatgaaagctcagcgctactat

SEQ ID NO: 1392 - DNA, 34 bp, Artificial Sequence
  Description of Artificial Sequence: Synthetic oligonucleotide
cagaaggccatgaaagctcagcgctactatattg

SEQ ID NO: 1393 - DNA, 38 bp, Artificial Sequence
  Description of Artificial Sequence: Synthetic oligonucleotide
cagaaggccatgaaagctcagcgctactatattgtctc

SEQ ID NO: 1394 - DNA, 37 bp, Artificial Sequence
  Description of Artificial Sequence: Synthetic oligonucleotide
catgaagcatttgaaatagcagaaggccatgaaagct

SEQ ID NO: 1395 - DNA, 40 bp, Artificial Sequence
  Description of Artificial Sequence: Synthetic oligonucleotide
catgaccatgagacaatatagtagcgctgagctttcatgg

SEQ ID NO: 1396 - DNA, 37 bp, Artificial Sequence
  Description of Artificial Sequence: Synthetic oligonucleotide
catgagacaatatagtagcgctgagctttcatggcct

SEQ ID NO: 1397 - DNA, 29 bp, Artificial Sequence
  Description of Artificial Sequence: Synthetic oligonucleotide
catttgaaatagcagaaggccatgaaagc

SEQ ID NO: 1398 - DNA, 33 bp, Artificial Sequence
  Description of Artificial Sequence: Synthetic oligonucleotide
catttgaaatagcagaaggccatgaaagctcag

SEQ ID NO: 1399 - DNA, 37 bp, Artificial Sequence
  Description of Artificial Sequence: Synthetic oligonucleotide
catttgaaatagcagaaggccatgaaagctcagcgct

SEQ ID NO: 1400 - DNA, 12 bp, Artificial Sequence
  Description of Artificial Sequence: Synthetic oligonucleotide
ccatgaaagctc

SEQ ID NO: 1401 - DNA, 16 bp, Artificial Sequence
  Description of Artificial Sequence: Synthetic oligonucleotide
ccatgaaagctcagcg

SEQ ID NO: 1402 - DNA, 20 bp, Artificial Sequence
  Description of Artificial Sequence: Synthetic oligonucleotide
ccatgaaagctcagcgctac

SEQ ID NO: 1403 - DNA, 24 bp, Artificial Sequence
  Description of Artificial Sequence: Synthetic oligonucleotide
ccatgaaagctcagcgctactata

SEQ ID NO: 1404 - DNA, 28 bp, Artificial Sequence
  Description of Artificial Sequence: Synthetic oligonucleotide
ccatgaaagctcagcgctactatattgt

SEQ ID NO: 1405 - DNA, 32 bp, Artificial Sequence
  Description of Artificial Sequence: Synthetic oligonucleotide
ccatgaaagctcagcgctactatattgtctca

SEQ ID NO: 1406 - DNA, 36 bp, Artificial Sequence
  Description of Artificial Sequence: Synthetic oligonucleotide
ccatgaaagctcagcgctactatattgtctcatggt

SEQ ID NO: 1407 - DNA, 40 bp, Artificial Sequence
  Description of Artificial Sequence: Synthetic oligonucleotide
ccatgaaagctcagcgctactatattgtctcatggtcatg

SEQ ID NO: 1408 - DNA, 38 bp, Artificial Sequence
  Description of Artificial Sequence: Synthetic oligonucleotide
ccatgagacaatatagtagcgctgagctttcatggcct

SEQ ID NO: 1409 - DNA, 17 bp, Artificial Sequence
  Description of Artificial Sequence: Synthetic oligonucleotide
cgctgagctttcatggc

SEQ ID NO: 1410 - DNA, 21 bp, Artificial Sequence
  Description of Artificial Sequence: Synthetic oligonucleotide
cgctgagctttcatggccttc

SEQ ID NO: 1411 - DNA, 25 bp, Artificial Sequence
  Description of Artificial Sequence: Synthetic oligonucleotide
cgctgagctttcatggccttctgct

SEQ ID NO: 1412 - DNA, 29 bp, Artificial Sequence
  Description of Artificial Sequence: Synthetic oligonucleotide
cgctgagctttcatggccttctgctattt

SEQ ID NO: 1413 - DNA, 33 bp, Artificial Sequence
  Description of Artificial Sequence: Synthetic oligonucleotide
cgctgagctttcatggccttctgctatttcaaa

SEQ ID NO: 1414 - DNA, 38 bp, Artificial Sequence
  Description of Artificial Sequence: Synthetic oligonucleotide
cgctgagctttcatggccttctgctatttcaaatgctt

SEQ ID NO: 1415 - DNA, 16 bp, Artificial Sequence
  Description of Artificial Sequence: Synthetic oligonucleotide
ctgagctttcatggcc

SEQ ID NO: 1416 - DNA, 20 bp, Artificial Sequence
  Description of Artificial Sequence: Synthetic oligonucleotide
ctgagctttcatggccttct

SEQ ID NO: 1417 - DNA, 24 bp, Artificial Sequence
  Description of Artificial Sequence: Synthetic oligonucleotide
ctgagctttcatggccttctgcta

SEQ ID NO: 1418 - DNA, 28 bp, Artificial Sequence
  Description of Artificial Sequence: Synthetic oligonucleotide
ctgagctttcatggccttctgctatttc

SEQ ID NO: 1419 - DNA, 32 bp, Artificial Sequence
  Description of Artificial Sequence: Synthetic oligonucleotide
ctgagctttcatggccttctgctatttcaaat

SEQ ID NO: 1420 - DNA, 36 bp, Artificial Sequence
  Description of Artificial Sequence: Synthetic oligonucleotide
ctgagctttcatggccttctgctatttcaaatgctt

SEQ ID NO: 1421 - DNA, 40 bp, Artificial Sequence
  Description of Artificial Sequence: Synthetic oligonucleotide
ctgagctttcatggccttctgctatttcaaatgcttcatg

SEQ ID NO: 1422 - DNA, 22 bp, Artificial Sequence
  Description of Artificial Sequence: Synthetic oligonucleotide
tagcagaaggccatgaaagctc

SEQ ID NO: 1423 - DNA, 26 bp, Artificial Sequence
  Description of Artificial Sequence: Synthetic oligonucleotide
tagcagaaggccatgaaagctcagcg

SEQ ID NO: 1424 - DNA, 30 bp, Artificial Sequence
  Description of Artificial Sequence: Synthetic oligonucleotide
tagcagaaggccatgaaagctcagcgctac

SEQ ID NO: 1425 - DNA, 34 bp, Artificial Sequence
  Description of Artificial Sequence: Synthetic oligonucleotide
tagcagaaggccatgaaagctcagcgctactata

SEQ ID NO: 1426 - DNA, 40 bp, Artificial Sequence
  Description of Artificial Sequence: Synthetic oligonucleotide
tagcagaaggccatgaaagctcagcgctactatattgtct

SEQ ID NO: 1427 - DNA, 22 bp, Artificial Sequence
  Description of Artificial Sequence: Synthetic oligonucleotide
tagcgctgagctttcatggcct

SEQ ID NO: 1428 - DNA, 26 bp, Artificial Sequence
  Description of Artificial Sequence: Synthetic oligonucleotide
tagcgctgagctttcatggccttctg

SEQ ID NO: 1429 - DNA, 30 bp, Artificial Sequence
  Description of Artificial Sequence: Synthetic oligonucleotide
tagcgctgagctttcatggccttctgctat

SEQ ID NO: 1430 - DNA, 34 bp, Artificial Sequence
  Description of Artificial Sequence: Synthetic oligonucleotide
tagcgctgagctttcatggccttctgctatttca

SEQ ID NO: 1431 - DNA, 38 bp, Artificial Sequence
  Description of Artificial Sequence: Synthetic oligonucleotide
tagcgctgagctttcatggccttctgctatttcaaatg

SEQ ID NO: 1432 - DNA, 25 bp, Artificial Sequence
  Description of Artificial Sequence: Synthetic oligonucleotide
tagtagcgctgagctttcatggcct

SEQ ID NO: 1433 - DNA, 29 bp, Artificial Sequence
  Description of Artificial Sequence: Synthetic oligonucleotide
tagtagcgctgagctttcatggccttctg

SEQ ID NO: 1434 - DNA, 33 bp, Artificial Sequence
  Description of Artificial Sequence: Synthetic oligonucleotide
tagtagcgctgagctttcatggccttctgctat

SEQ ID NO: 1435 - DNA, 37 bp, Artificial Sequence
  Description of Artificial Sequence: Synthetic oligonucleotide
tagtagcgctgagctttcatggccttctgctatttca

SEQ ID NO: 1436 - DNA, 24 bp, Artificial Sequence
  Description of Artificial Sequence: Synthetic oligonucleotide
tatagtagcgctgagctttcatgg

SEQ ID NO: 1437 - DNA, 28 bp, Artificial Sequence
  Description of Artificial Sequence: Synthetic oligonucleotide
tatagtagcgctgagctttcatggcctt

SEQ ID NO: 1438 - DNA, 32 bp, Artificial Sequence
  Description of Artificial Sequence: Synthetic oligonucleotide
tatagtagcgctgagctttcatggccttctgc

SEQ ID NO: 1439 - DNA, 36 bp, Artificial Sequence
  Description of Artificial Sequence: Synthetic oligonucleotide
tatagtagcgctgagctttcatggccttctgctatt

SEQ ID NO: 1440 - DNA, 40 bp, Artificial Sequence
  Description of Artificial Sequence: Synthetic oligonucleotide
tatagtagcgctgagctttcatggccttctgctatttcaa

SEQ ID NO: 1441 - DNA, 40 bp, Artificial Sequence
  Description of Artificial Sequence: Synthetic oligonucleotide
tcatgaagcatttgaaatagcagaaggccatgaaagctca

SEQ ID NO: 1442 - DNA, 28 bp, Artificial Sequence
  Description of Artificial Sequence: Synthetic oligonucleotide
tgaaatagcagaaggccatgaaagctca

SEQ ID NO: 1443 - DNA, 32 bp, Artificial Sequence
  Description of Artificial Sequence: Synthetic oligonucleotide
tgaaatagcagaaggccatgaaagctcagcgc

SEQ ID NO: 1444 - DNA, 36 bp, Artificial Sequence
  Description of Artificial Sequence: Synthetic oligonucleotide
tgaaatagcagaaggccatgaaagctcagcgctact

SEQ ID NO: 1445 - DNA, 40 bp, Artificial Sequence
  Description of Artificial Sequence: Synthetic oligonucleotide
tgaaatagcagaaggccatgaaagctcagcgctactatat

SEQ ID NO: 1446 - DNA, 37 bp, Artificial Sequence
  Description of Artificial Sequence: Synthetic oligonucleotide
tgaagcatttgaaatagcagaaggccatgaaagctca

SEQ ID NO: 1447 - DNA, 38 bp, Artificial Sequence
  Description of Artificial Sequence: Synthetic oligonucleotide
tgaccatgagacaatatagtagcgctgagctttcatgg

SEQ ID NO: 1448 - DNA, 33 bp, Artificial Sequence
  Description of Artificial Sequence: Synthetic oligonucleotide
tgagacaatatagtagcgctgagctttcatggc

SEQ ID NO: 1449 - DNA, 37 bp, Artificial Sequence
  Description of Artificial Sequence: Synthetic oligonucleotide
tgagacaatatagtagcgctgagctttcatggccttc

SEQ ID NO: 1450 - DNA, 13 bp, Artificial Sequence
  Description of Artificial Sequence: Synthetic oligonucleotide
tgagctttcatgg

SEQ ID NO: 1451 - DNA, 17 bp, Artificial Sequence
  Description of Artificial Sequence: Synthetic oligonucleotide
tgagctttcatggcctt

SEQ ID NO: 1452 - DNA, 21 bp, Artificial Sequence
  Description of Artificial Sequence: Synthetic oligonucleotide
tgagctttcatggccttctgc

SEQ ID NO: 1453 - DNA, 25 bp, Artificial Sequence
  Description of Artificial Sequence: Synthetic oligonucleotide
tgagctttcatggccttctgctatt

SEQ ID NO: 1454 - DNA, 29 bp, Artificial Sequence
  Description of Artificial Sequence: Synthetic oligonucleotide
tgagctttcatggccttctgctatttcaa

SEQ ID NO: 1455 - DNA, 33 bp, Artificial Sequence
  Description of Artificial Sequence: Synthetic oligonucleotide
tgagctttcatggccttctgctatttcaaatgc

SEQ ID NO: 1456 - DNA, 37 bp, Artificial Sequence
  Description of Artificial Sequence: Synthetic oligonucleotide
tgagctttcatggccttctgctatttcaaatgcttca

SEQ ID NO: 1457 - DNA, 38 bp, Artificial Sequence
  Description of Artificial Sequence: Synthetic oligonucleotide
ttcatgaagcatttgaaatagcagaaggccatgaaagc

SEQ ID NO: 1458 - DNA, 27 bp, Artificial Sequence
  Description of Artificial Sequence: Synthetic oligonucleotide
ttgaaatagcagaaggccatgaaagct

SEQ ID NO: 1459 - DNA, 31 bp, Artificial Sequence
  Description of Artificial Sequence: Synthetic oligonucleotide
ttgaaatagcagaaggccatgaaagctcagc

SEQ ID NO: 1460 - DNA, 35 bp, Artificial Sequence
  Description of Artificial Sequence: Synthetic oligonucleotide
ttgaaatagcagaaggccatgaaagctcagcgcta

SEQ ID NO: 1461 - DNA, 39 bp, Artificial Sequence
  Description of Artificial Sequence: Synthetic oligonucleotide
ttgaaatagcagaaggccatgaaagctcagcgctactat

SEQ ID NO: 1462 - DNA, 27 bp, Artificial Sequence
  Description of Artificial Sequence: Synthetic oligonucleotide
tttgaaatagcagaaggccatgaaagc

SEQ ID NO: 1463 - DNA, 31 bp, Artificial Sequence
  Description of Artificial Sequence: Synthetic oligonucleotide
tttgaaatagcagaaggccatgaaagctcag

SEQ ID NO: 1464 - DNA, 35 bp, Artificial Sequence
  Description of Artificial Sequence: Synthetic oligonucleotide
tttgaaatagcagaaggccatgaaagctcagcgct

SEQ ID NO: 1465 - DNA, 39 bp, Artificial Sequence
  Description of Artificial Sequence: Synthetic oligonucleotide
tttgaaatagcagaaggccatgaaagctcagcgctacta

SEQ ID NO: 1466 - DNA, 34 bp, Artificial Sequence
  Description of Artificial Sequence: Synthetic oligonucleotide
aagccagattcattatggtattcggcaagactat

SEQ ID NO: 1467 - DNA, 38 bp, Artificial Sequence
  Description of Artificial Sequence: Synthetic oligonucleotide
aagccagattcattatggtattcggcaagactatgctc

SEQ ID NO: 1468 - DNA, 28 bp, Artificial Sequence
  Description of Artificial Sequence: Synthetic oligonucleotide
aagtaggacctgagcatagtcttgccga

SEQ ID NO: 1469 - DNA, 32 bp, Artificial Sequence
  Description of Artificial Sequence: Synthetic oligonucleotide
aagtaggacctgagcatagtcttgccgaatac

SEQ ID NO: 1470 - DNA, 36 bp, Artificial Sequence
  Description of Artificial Sequence: Synthetic oligonucleotide
aagtaggacctgagcatagtcttgccgaataccata

SEQ ID NO: 1471 - DNA, 40 bp, Artificial Sequence
  Description of Artificial Sequence: Synthetic oligonucleotide
aagtaggacctgagcatagtcttgccgaataccataatga

SEQ ID NO: 1472 - DNA, 37 bp, Artificial Sequence
  Description of Artificial Sequence: Synthetic oligonucleotide
aattcagaagtaggacctgagcatagtcttgccgaat

SEQ ID NO: 1473 - DNA, 36 bp, Artificial Sequence
  Description of Artificial Sequence: Synthetic oligonucleotide
acaattcagaagtaggacctgagcatagtcttgccg

SEQ ID NO: 1474 - DNA, 40 bp, Artificial Sequence
  Description of Artificial Sequence: Synthetic oligonucleotide
acaattcagaagtaggacctgagcatagtcttgccgaata

SEQ ID NO: 1475 - DNA, 23 bp, Artificial Sequence
  Description of Artificial Sequence: Synthetic oligonucleotide
acctgagcatagtcttgccgaat

SEQ ID NO: 1476 - DNA, 27 bp, Artificial Sequence
  Description of Artificial Sequence: Synthetic oligonucleotide
acctgagcatagtcttgccgaatacca

SEQ ID NO: 1477 - DNA, 31 bp, Artificial Sequence
  Description of Artificial Sequence: Synthetic oligonucleotide
acctgagcatagtcttgccgaataccataat

SEQ ID NO: 1478 - DNA, 35 bp, Artificial Sequence
  Description of Artificial Sequence: Synthetic oligonucleotide
acctgagcatagtcttgccgaataccataatgaat

SEQ ID NO: 1479 - DNA, 39 bp, Artificial Sequence
  Description of Artificial Sequence: Synthetic oligonucleotide
acctgagcatagtcttgccgaataccataatgaatctgg

SEQ ID NO: 1480 - DNA, 31 bp, Artificial Sequence
  Description of Artificial Sequence: Synthetic oligonucleotide
agaagtaggacctgagcatagtcttgccgaa

SEQ ID NO: 1481 - DNA, 35 bp, Artificial Sequence
  Description of Artificial Sequence: Synthetic oligonucleotide
agaagtaggacctgagcatagtcttgccgaatacc

SEQ ID NO: 1482 - DNA, 39 bp, Artificial Sequence
  Description of Artificial Sequence: Synthetic oligonucleotide
agaagtaggacctgagcatagtcttgccgaataccataa

SEQ ID NO: 1483 - DNA, 29 bp, Artificial Sequence
  Description of Artificial Sequence: Synthetic oligonucleotide
agattcattatggtattcggcaagactat

SEQ ID NO: 1484 - DNA, 33 bp, Artificial Sequence
  Description of Artificial Sequence: Synthetic oligonucleotide
agattcattatggtattcggcaagactatgctc

SEQ ID NO: 1485 - DNA, 37 bp, Artificial Sequence
  Description of Artificial Sequence: Synthetic oligonucleotide
agattcattatggtattcggcaagactatgctcaggt

SEQ ID NO: 1486 - DNA, 15 bp, Artificial Sequence
  Description of Artificial Sequence: Synthetic oligonucleotide
agcatagtcttgccg

SEQ ID NO: 1487 - DNA, 19 bp, Artificial Sequence
  Description of Artificial Sequence: Synthetic oligonucleotide
agcatagtcttgccgaata

SEQ ID NO: 1488 - DNA, 23 bp, Artificial Sequence
  Description of Artificial Sequence: Synthetic oligonucleotide
agcatagtcttgccgaataccat

SEQ ID NO: 1489 - DNA, 27 bp, Artificial Sequence
  Description of Artificial Sequence: Synthetic oligonucleotide
agcatagtcttgccgaataccataatg

SEQ ID NO: 1490 - DNA, 31 bp, Artificial Sequence
  Description of Artificial Sequence: Synthetic oligonucleotide
agcatagtcttgccgaataccataatgaatc

SEQ ID NO: 1491 - DNA, 35 bp, Artificial Sequence
  Description of Artificial Sequence: Synthetic oligonucleotide
agcatagtcttgccgaataccataatgaatctggc

SEQ ID NO: 1492 - DNA, 39 bp, Artificial Sequence
  Description of Artificial Sequence: Synthetic oligonucleotide
agcatagtcttgccgaataccataatgaatctggcttga

SEQ ID NO: 1493 - DNA, 33 bp, Artificial Sequence
  Description of Artificial Sequence: Synthetic oligonucleotide
agccagattcattatggtattcggcaagactat

SEQ ID NO: 1494 - DNA, 37 bp, Artificial Sequence
  Description of Artificial Sequence: Synthetic oligonucleotide
agccagattcattatggtattcggcaagactatgctc

SEQ ID NO: 1495 - DNA, 23 bp, Artificial Sequence
  Description of Artificial Sequence: Synthetic oligonucleotide
aggacctgagcatagtcttgccg

SEQ ID NO: 1496 - DNA, 27 bp, Artificial Sequence
  Description of Artificial Sequence: Synthetic oligonucleotide
aggacctgagcatagtcttgccgaata

SEQ ID NO: 1497 - DNA, 31 bp, Artificial Sequence
  Description of Artificial Sequence: Synthetic oligonucleotide
aggacctgagcatagtcttgccgaataccat

SEQ ID NO: 1498 - DNA, 35 bp, Artificial Sequence
  Description of Artificial Sequence: Synthetic oligonucleotide
aggacctgagcatagtcttgccgaataccataatg

SEQ ID NO: 1499 - DNA, 39 bp, Artificial Sequence
  Description of Artificial Sequence: Synthetic oligonucleotide
aggacctgagcatagtcttgccgaataccataatgaatc

SEQ ID NO: 1500 - DNA, 28 bp, Artificial Sequence
  Description of Artificial Sequence: Synthetic oligonucleotide
agtaggacctgagcatagtcttgccgaa

SEQ ID NO: 1501 - DNA, 32 bp, Artificial Sequence
  Description of Artificial Sequence: Synthetic oligonucleotide
agtaggacctgagcatagtcttgccgaatacc

SEQ ID NO: 1502 - DNA, 36 bp, Artificial Sequence
  Description of Artificial Sequence: Synthetic oligonucleotide
agtaggacctgagcatagtcttgccgaataccataa

SEQ ID NO: 1503 - DNA, 40 bp, Artificial Sequence
  Description of Artificial Sequence: Synthetic oligonucleotide
agtaggacctgagcatagtcttgccgaataccataatgaa

SEQ ID NO: 1504 - DNA, 15 bp, Artificial Sequence
  Description of Artificial Sequence: Synthetic oligonucleotide
agtcttgccgaatac

SEQ ID NO: 1505 - DNA, 19 bp, Artificial Sequence
  Description of Artificial Sequence: Synthetic oligonucleotide
agtcttgccgaataccata

SEQ ID NO: 1506 - DNA, 23 bp, Artificial Sequence
  Description of Artificial Sequence: Synthetic oligonucleotide
agtcttgccgaataccataatga

SEQ ID NO: 1507 - DNA, 27 bp, Artificial Sequence
  Description of Artificial Sequence: Synthetic oligonucleotide
agtcttgccgaataccataatgaatct

SEQ ID NO: 1508 - DNA, 31 bp, Artificial Sequence
  Description of Artificial Sequence: Synthetic oligonucleotide
agtcttgccgaataccataatgaatctggct

SEQ ID NO: 1509 - DNA, 35 bp, Artificial Sequence
  Description of Artificial Sequence: Synthetic oligonucleotide
agtcttgccgaataccataatgaatctggcttgaa

SEQ ID NO: 1510 - DNA, 39 bp, Artificial Sequence
  Description of Artificial Sequence: Synthetic oligonucleotide
agtcttgccgaataccataatgaatctggcttgaaaacc

SEQ ID NO: 1511 - DNA, 14 bp, Artificial Sequence
  Description of Artificial Sequence: Synthetic oligonucleotide
atagtcttgccgaa

SEQ ID NO: 1512 - DNA, 18 bp, Artificial Sequence
  Description of Artificial Sequence: Synthetic oligonucleotide
atagtcttgccgaatacc

SEQ ID NO: 1513 - DNA, 22 bp, Artificial Sequence
  Description of Artificial Sequence: Synthetic oligonucleotide
atagtcttgccgaataccataa

SEQ ID NO: 1514 - DNA, 26 bp, Artificial Sequence
  Description of Artificial Sequence: Synthetic oligonucleotide
atagtcttgccgaataccataatgaa

SEQ ID NO: 1515 - DNA, 30 bp, Artificial Sequence
  Description of Artificial Sequence: Synthetic oligonucleotide
atagtcttgccgaataccataatgaatctg

SEQ ID NO: 1516 - DNA, 34 bp, Artificial Sequence
  Description of Artificial Sequence: Synthetic oligonucleotide
atagtcttgccgaataccataatgaatctggctt

SEQ ID NO: 1517 - DNA, 38 bp, Artificial Sequence
  Description of Artificial Sequence: Synthetic oligonucleotide
atagtcttgccgaataccataatgaatctggcttgaaa

SEQ ID NO: 1518 - DNA, 19 bp, Artificial Sequence
  Description of Artificial Sequence: Synthetic oligonucleotide
atggtattcggcaagacta

SEQ ID NO: 1519 - DNA, 23 bp, Artificial Sequence
  Description of Artificial Sequence: Synthetic oligonucleotide
atggtattcggcaagactatgct

SEQ ID NO: 1520 - DNA, 27 bp, Artificial Sequence
  Description of Artificial Sequence: Synthetic oligonucleotide
atggtattcggcaagactatgctcagg

SEQ ID NO: 1521 - DNA, 31 bp, Artificial Sequence
  Description of Artificial Sequence: Synthetic oligonucleotide
atggtattcggcaagactatgctcaggtcct

SEQ ID NO: 1522 - DNA, 35 bp, Artificial Sequence
  Description of Artificial Sequence: Synthetic oligonucleotide
atggtattcggcaagactatgctcaggtcctactt

SEQ ID NO: 1523 - DNA, 39 bp, Artificial Sequence
  Description of Artificial Sequence: Synthetic oligonucleotide
atggtattcggcaagactatgctcaggtcctacttctga

SEQ ID NO: 1524 - DNA, 23 bp, Artificial Sequence
  Description of Artificial Sequence: Synthetic oligonucleotide
attatggtattcggcaagactat

SEQ ID NO: 1525 - DNA, 27 bp, Artificial Sequence
  Description of Artificial Sequence: Synthetic oligonucleotide
attatggtattcggcaagactatgctc

SEQ ID NO: 1526 - DNA, 31 bp, Artificial Sequence
  Description of Artificial Sequence: Synthetic oligonucleotide
attatggtattcggcaagactatgctcaggt

SEQ ID NO: 1527 - DNA, 35 bp, Artificial Sequence
  Description of Artificial Sequence: Synthetic oligonucleotide
attatggtattcggcaagactatgctcaggtccta

SEQ ID NO: 1528 - DNA, 39 bp, Artificial Sequence
  Description of Artificial Sequence: Synthetic oligonucleotide
attatggtattcggcaagactatgctcaggtcctacttc

SEQ ID NO: 1529 - DNA, 35 bp, Artificial Sequence
  Description of Artificial Sequence: Synthetic oligonucleotide
attcagaagtaggacctgagcatagtcttgccgaa

SEQ ID NO: 1530 - DNA, 39 bp, Artificial Sequence
  Description of Artificial Sequence: Synthetic oligonucleotide
attcagaagtaggacctgagcatagtcttgccgaatacc

SEQ ID NO: 1531 - DNA, 27 bp, Artificial Sequence
  Description of Artificial Sequence: Synthetic oligonucleotide
attcattatggtattcggcaagactat

SEQ ID NO: 1532 - DNA, 31 bp, Artificial Sequence
  Description of Artificial Sequence: Synthetic oligonucleotide
attcattatggtattcggcaagactatgctc

SEQ ID NO: 1533 - DNA, 35 bp, Artificial Sequence
  Description of Artificial Sequence: Synthetic oligonucleotide
attcattatggtattcggcaagactatgctcaggt

SEQ ID NO: 1534 - DNA, 39 bp, Artificial Sequence
  Description of Artificial Sequence: Synthetic oligonucleotide
attcattatggtattcggcaagactatgctcaggtccta

SEQ ID NO: 1535 - DNA, 15 bp, Artificial Sequence
  Description of Artificial Sequence: Synthetic oligonucleotide
attcggcaagactat

SEQ ID NO: 1536 - DNA, 19 bp, Artificial Sequence
  Description of Artificial Sequence: Synthetic oligonucleotide
attcggcaagactatgctc

SEQ ID NO: 1537 - DNA, 23 bp, Artificial Sequence
  Description of Artificial Sequence: Synthetic oligonucleotide
attcggcaagactatgctcaggt

SEQ ID NO: 1538 - DNA, 27 bp, Artificial Sequence
  Description of Artificial Sequence: Synthetic oligonucleotide
attcggcaagactatgctcaggtccta

SEQ ID NO: 1539 - DNA, 31 bp, Artificial Sequence
  Description of Artificial Sequence: Synthetic oligonucleotide
attcggcaagactatgctcaggtcctacttc

SEQ ID NO: 1540 - DNA, 35 bp, Artificial Sequence
  Description of Artificial Sequence: Synthetic oligonucleotide
attcggcaagactatgctcaggtcctacttctgaa

SEQ ID NO: 1541 - DNA, 39 bp, Artificial Sequence
  Description of Artificial Sequence: Synthetic oligonucleotide
attcggcaagactatgctcaggtcctacttctgaattgt

SEQ ID NO: 1542 - DNA, 36 bp, Artificial Sequence
  Description of Artificial Sequence: Synthetic oligonucleotide
caagccagattcattatggtattcggcaagactatg

SEQ ID NO: 1543 - DNA, 40 bp, Artificial Sequence
  Description of Artificial Sequence: Synthetic oligonucleotide
caagccagattcattatggtattcggcaagactatgctca

SEQ ID NO: 1544 - DNA, 38 bp, Artificial Sequence
  Description of Artificial Sequence: Synthetic oligonucleotide
caattcagaagtaggacctgagcatagtcttgccgaat

SEQ ID NO: 1545 - DNA, 38 bp, Artificial Sequence
  Description of Artificial Sequence: Synthetic oligonucleotide
cacaattcagaagtaggacctgagcatagtcttgccga

SEQ ID NO: 1546 - DNA, 31 bp, Artificial Sequence
  Description of Artificial Sequence: Synthetic oligonucleotide
cagaagtaggacctgagcatagtcttgccga

SEQ ID NO: 1547 - DNA, 35 bp, Artificial Sequence
  Description of Artificial Sequence: Synthetic oligonucleotide
cagaagtaggacctgagcatagtcttgccgaatac

SEQ ID NO: 1548 - DNA, 39 bp, Artificial Sequence
  Description of Artificial Sequence: Synthetic oligonucleotide
cagaagtaggacctgagcatagtcttgccgaataccata

SEQ ID NO: 1549 - DNA, 30 bp, Artificial Sequence
  Description of Artificial Sequence: Synthetic oligonucleotide
cagattcattatggtattcggcaagactat

SEQ ID NO: 1550 - DNA, 34 bp, Artificial Sequence
  Description of Artificial Sequence: Synthetic oligonucleotide
cagattcattatggtattcggcaagactatgctc

SEQ ID NO: 1551 - DNA, 38 bp, Artificial Sequence
  Description of Artificial Sequence: Synthetic oligonucleotide
cagattcattatggtattcggcaagactatgctcaggt

SEQ ID NO: 1552 - DNA, 14 bp, Artificial Sequence
  Description of Artificial Sequence: Synthetic oligonucleotide
catagtcttgccga

SEQ ID NO: 1553 - DNA, 18 bp, Artificial Sequence
  Description of Artificial Sequence: Synthetic oligonucleotide
catagtcttgccgaatac

SEQ ID NO: 1554 - DNA, 22 bp, Artificial Sequence
  Description of Artificial Sequence: Synthetic oligonucleotide
catagtcttgccgaataccata

SEQ ID NO: 1555 - DNA, 26 bp, Artificial Sequence
  Description of Artificial Sequence: Synthetic oligonucleotide
catagtcttgccgaataccataatga

SEQ ID NO: 1556 - DNA, 30 bp, Artificial Sequence
  Description of Artificial Sequence: Synthetic oligonucleotide
catagtcttgccgaataccataatgaatct

SEQ ID NO: 1557 - DNA, 34 bp, Artificial Sequence
  Description of Artificial Sequence: Synthetic oligonucleotide
catagtcttgccgaataccataatgaatctggct

SEQ ID NO: 1558 - DNA, 38 bp, Artificial Sequence
  Description of Artificial Sequence: Synthetic oligonucleotide
catagtcttgccgaataccataatgaatctggcttgaa

SEQ ID NO: 1559 - DNA, 23 bp, Artificial Sequence
  Description of Artificial Sequence: Synthetic oligonucleotide
cattatggtattcggcaagacta

SEQ ID NO: 1560 - DNA, 27 bp, Artificial Sequence
  Description of Artificial Sequence: Synthetic oligonucleotide
cattatggtattcggcaagactatgct

SEQ ID NO: 1561 - DNA, 31 bp, Artificial Sequence
  Description of Artificial Sequence: Synthetic oligonucleotide
cattatggtattcggcaagactatgctcagg

SEQ ID NO: 1562 - DNA, 35 bp, Artificial Sequence
  Description of Artificial Sequence: Synthetic oligonucleotide
cattatggtattcggcaagactatgctcaggtcct

SEQ ID NO: 1563 - DNA, 39 bp, Artificial Sequence
  Description of Artificial Sequence: Synthetic oligonucleotide
cattatggtattcggcaagactatgctcaggtcctactt

SEQ ID NO: 1564 - DNA, 31 bp, Artificial Sequence
  Description of Artificial Sequence: Synthetic oligonucleotide
ccagattcattatggtattcggcaagactat

SEQ ID NO: 1565 - DNA, 35 bp, Artificial Sequence
  Description of Artificial Sequence: Synthetic oligonucleotide
ccagattcattatggtattcggcaagactatgctc

SEQ ID NO: 1566 - DNA, 39 bp, Artificial Sequence
  Description of Artificial Sequence: Synthetic oligonucleotide
ccagattcattatggtattcggcaagactatgctcaggt

SEQ ID NO: 1567 - DNA, 21 bp, Artificial Sequence
  Description of Artificial Sequence: Synthetic oligonucleotide
cctgagcatagtcttgccgaa

SEQ ID NO: 1568 - DNA, 25 bp, Artificial Sequence
  Description of Artificial Sequence: Synthetic oligonucleotide
cctgagcatagtcttgccgaatacc

SEQ ID NO: 1569 - DNA, 29 bp, Artificial Sequence
  Description of Artificial Sequence: Synthetic oligonucleotide
cctgagcatagtcttgccgaataccataa

SEQ ID NO: 1570 - DNA, 33 bp, Artificial Sequence
  Description of Artificial Sequence: Synthetic oligonucleotide
cctgagcatagtcttgccgaataccataatgaa

SEQ ID NO: 1571 - DNA, 37 bp, Artificial Sequence
  Description of Artificial Sequence: Synthetic oligonucleotide
cctgagcatagtcttgccgaataccataatgaatctg

SEQ ID NO: 1572 - DNA, 12 bp, Artificial Sequence
  Description of Artificial Sequence: Synthetic oligonucleotide
cggcaagactat

SEQ ID NO: 1573 - DNA, 16 bp, Artificial Sequence
  Description of Artificial Sequence: Synthetic oligonucleotide
cggcaagactatgctc

SEQ ID NO: 1574 - DNA, 20 bp, Artificial Sequence
  Description of Artificial Sequence: Synthetic oligonucleotide
cggcaagactatgctcaggt

SEQ ID NO: 1575 - DNA, 24 bp, Artificial Sequence
  Description of Artificial Sequence: Synthetic oligonucleotide
cggcaagactatgctcaggtccta

SEQ ID NO: 1576 - DNA, 28 bp, Artificial Sequence
  Description of Artificial Sequence: Synthetic oligonucleotide
cggcaagactatgctcaggtcctacttc

SEQ ID NO: 1577 - DNA, 32 bp, Artificial Sequence
  Description of Artificial Sequence: Synthetic oligonucleotide
cggcaagactatgctcaggtcctacttctgaa

SEQ ID NO: 1578 - DNA, 36 bp, Artificial Sequence
  Description of Artificial Sequence: Synthetic oligonucleotide
cggcaagactatgctcaggtcctacttctgaattgt

SEQ ID NO: 1579 - DNA, 40 bp, Artificial Sequence
  Description of Artificial Sequence: Synthetic oligonucleotide
cggcaagactatgctcaggtcctacttctgaattgtgaca

SEQ ID NO: 1580 - DNA, 21 bp, Artificial Sequence
  Description of Artificial Sequence: Synthetic oligonucleotide
ctgagcatagtcttgccgaat

SEQ ID NO: 1581 - DNA, 25 bp, Artificial Sequence
  Description of Artificial Sequence: Synthetic oligonucleotide
ctgagcatagtcttgccgaatacca

SEQ ID NO: 1582 - DNA, 29 bp, Artificial Sequence
  Description of Artificial Sequence: Synthetic oligonucleotide
ctgagcatagtcttgccgaataccataat

SEQ ID NO: 1583 - DNA, 33 bp, Artificial Sequence
  Description of Artificial Sequence: Synthetic oligonucleotide
ctgagcatagtcttgccgaataccataatgaat

SEQ ID NO: 1584 - DNA, 37 bp, Artificial Sequence
  Description of Artificial Sequence: Synthetic oligonucleotide
ctgagcatagtcttgccgaataccataatgaatctgg

SEQ ID NO: 1585 - DNA, 24 bp, Artificial Sequence
  Description of Artificial Sequence: Synthetic oligonucleotide
taggacctgagcatagtcttgccg

SEQ ID NO: 1586 - DNA, 28 bp, Artificial Sequence
  Description of Artificial Sequence: Synthetic oligonucleotide
taggacctgagcatagtcttgccgaata

SEQ ID NO: 1587 - DNA, 32 bp, Artificial Sequence
  Description of Artificial Sequence: Synthetic oligonucleotide
taggacctgagcatagtcttgccgaataccat

SEQ ID NO: 1588 - DNA, 36 bp, Artificial Sequence
  Description of Artificial Sequence: Synthetic oligonucleotide
taggacctgagcatagtcttgccgaataccataatg

SEQ ID NO: 1589 - DNA, 40 bp, Artificial Sequence
  Description of Artificial Sequence: Synthetic oligonucleotide
taggacctgagcatagtcttgccgaataccataatgaatc

SEQ ID NO: 1590 - DNA, 15 bp, Artificial Sequence
  Description of Artificial Sequence: Synthetic oligonucleotide
tagtcttgccgaata

SEQ ID NO: 1591 - DNA, 19 bp, Artificial Sequence
  Description of Artificial Sequence: Synthetic oligonucleotide
tagtcttgccgaataccat

SEQ ID NO: 1592 - DNA, 23 bp, Artificial Sequence
  Description of Artificial Sequence: Synthetic oligonucleotide
tagtcttgccgaataccataatg

SEQ ID NO: 1593 - DNA, 27 bp, Artificial Sequence
  Description of Artificial Sequence: Synthetic oligonucleotide
tagtcttgccgaataccataatgaatc

SEQ ID NO: 1594 - DNA, 31 bp, Artificial Sequence
  Description of Artificial Sequence: Synthetic oligonucleotide
tagtcttgccgaataccataatgaatctggc

SEQ ID NO: 1595 - DNA, 35 bp, Artificial Sequence
  Description of Artificial Sequence: Synthetic oligonucleotide
tagtcttgccgaataccataatgaatctggcttga

SEQ ID NO: 1596 - DNA, 39 bp, Artificial Sequence
  Description of Artificial Sequence: Synthetic oligonucleotide
tagtcttgccgaataccataatgaatctggcttgaaaac

SEQ ID NO: 1597 - DNA, 21 bp, Artificial Sequence
  Description of Artificial Sequence: Synthetic oligonucleotide
tatggtattcggcaagactat

SEQ ID NO: 1598 - DNA, 25 bp, Artificial Sequence
  Description of Artificial Sequence: Synthetic oligonucleotide
tatggtattcggcaagactatgctc

SEQ ID NO: 1599 - DNA, 29 bp, Artificial Sequence
  Description of Artificial Sequence: Synthetic oligonucleotide
tatggtattcggcaagactatgctcaggt

SEQ ID NO: 1600 - DNA, 33 bp, Artificial Sequence
  Description of Artificial Sequence: Synthetic oligonucleotide
tatggtattcggcaagactatgctcaggtccta

SEQ ID NO: 1601 - DNA, 37 bp, Artificial Sequence
  Description of Artificial Sequence: Synthetic oligonucleotide
tatggtattcggcaagactatgctcaggtcctacttc

SEQ ID NO: 1602 - DNA, 14 bp, Artificial Sequence
  Description of Artificial Sequence: Synthetic oligonucleotide
tattcggcaagact

SEQ ID NO: 1603 - DNA, 18 bp, Artificial Sequence
  Description of Artificial Sequence: Synthetic oligonucleotide
tattcggcaagactatgc

SEQ ID NO: 1604 - DNA, 22 bp, Artificial Sequence
  Description of Artificial Sequence: Synthetic oligonucleotide
tattcggcaagactatgctcag

SEQ ID NO: 1605 - DNA, 26 bp, Artificial Sequence
  Description of Artificial Sequence: Synthetic oligonucleotide
tattcggcaagactatgctcaggtcc

SEQ ID NO: 1606 - DNA, 30 bp, Artificial Sequence
  Description of Artificial Sequence: Synthetic oligonucleotide
tattcggcaagactatgctcaggtcctact

SEQ ID NO: 1607 - DNA, 34 bp, Artificial Sequence
  Description of Artificial Sequence: Synthetic oligonucleotide
tattcggcaagactatgctcaggtcctacttctg

SEQ ID NO: 1608 - DNA, 38 bp, Artificial Sequence
  Description of Artificial Sequence: Synthetic oligonucleotide
tattcggcaagactatgctcaggtcctacttctgaatt

SEQ ID NO: 1609 - DNA, 35 bp, Artificial Sequence
  Description of Artificial Sequence: Synthetic oligonucleotide
tcaagccagattcattatggtattcggcaagacta

SEQ ID NO: 1610 - DNA, 39 bp, Artificial Sequence
  Description of Artificial Sequence: Synthetic oligonucleotide
tcaagccagattcattatggtattcggcaagactatgct

SEQ ID NO: 1611 - DNA, 40 bp, Artificial Sequence
  Description of Artificial Sequence: Synthetic oligonucleotide
tcacaattcagaagtaggacctgagcatagtcttgccgaa

SEQ ID NO: 1612 - DNA, 34 bp, Artificial Sequence
  Description of Artificial Sequence: Synthetic oligonucleotide
tcagaagtaggacctgagcatagtcttgccgaat

SEQ ID NO: 1613 - DNA, 38 bp, Artificial Sequence
  Description of Artificial Sequence: Synthetic oligonucleotide
tcagaagtaggacctgagcatagtcttgccgaatacca

SEQ ID NO: 1614 - DNA, 25 bp, Artificial Sequence
  Description of Artificial Sequence: Synthetic oligonucleotide
tcattatggtattcggcaagactat

SEQ ID NO: 1615 - DNA, 29 bp, Artificial Sequence
  Description of Artificial Sequence: Synthetic oligonucleotide
tcattatggtattcggcaagactatgctc

SEQ ID NO: 1616 - DNA, 33 bp, Artificial Sequence
  Description of Artificial Sequence: Synthetic oligonucleotide
tcattatggtattcggcaagactatgctcaggt

SEQ ID NO: 1617 - DNA, 37 bp, Artificial Sequence
  Description of Artificial Sequence: Synthetic oligonucleotide
tcattatggtattcggcaagactatgctcaggtccta

SEQ ID NO: 1618 - DNA, 12 bp, Artificial Sequence
  Description of Artificial Sequence: Synthetic oligonucleotide
tcggcaagacta

SEQ ID NO: 1619 - DNA, 16 bp, Artificial Sequence
  Description of Artificial Sequence: Synthetic oligonucleotide
tcggcaagactatgct

SEQ ID NO: 1620 - DNA, 20 bp, Artificial Sequence
  Description of Artificial Sequence: Synthetic oligonucleotide
tcggcaagactatgctcagg

SEQ ID NO: 1621 - DNA, 24 bp, Artificial Sequence
  Description of Artificial Sequence: Synthetic oligonucleotide
tcggcaagactatgctcaggtcct

SEQ ID NO: 1622 - DNA, 28 bp, Artificial Sequence
  Description of Artificial Sequence: Synthetic oligonucleotide
tcggcaagactatgctcaggtcctactt

SEQ ID NO: 1623 - DNA, 32 bp, Artificial Sequence
  Description of Artificial Sequence: Synthetic oligonucleotide
tcggcaagactatgctcaggtcctacttctga

SEQ ID NO: 1624 - DNA, 36 bp, Artificial Sequence
  Description of Artificial Sequence: Synthetic oligonucleotide
tcggcaagactatgctcaggtcctacttctgaattg

SEQ ID NO: 1625 - DNA, 18 bp, Artificial Sequence
  Description of Artificial Sequence: Synthetic oligonucleotide
tgagcatagtcttgccga

SEQ ID NO: 1626 - DNA, 22 bp, Artificial Sequence
  Description of Artificial Sequence: Synthetic oligonucleotide
tgagcatagtcttgccgaatac

SEQ ID NO: 1627 - DNA, 26 bp, Artificial Sequence
  Description of Artificial Sequence: Synthetic oligonucleotide
tgagcatagtcttgccgaataccata

SEQ ID NO: 1628 - DNA, 30 bp, Artificial Sequence
  Description of Artificial Sequence: Synthetic oligonucleotide
tgagcatagtcttgccgaataccataatga

SEQ ID NO: 1629 - DNA, 34 bp, Artificial Sequence
  Description of Artificial Sequence: Synthetic oligonucleotide
tgagcatagtcttgccgaataccataatgaatct

SEQ ID NO: 1630 - DNA, 38 bp, Artificial Sequence
  Description of Artificial Sequence: Synthetic oligonucleotide
tgagcatagtcttgccgaataccataatgaatctggct

SEQ ID NO: 1631 - DNA, 18 bp, Artificial Sequence
  Description of Artificial Sequence: Synthetic oligonucleotide
tggtattcggcaagacta

SEQ ID NO: 1632 - DNA, 22 bp, Artificial Sequence
  Description of Artificial Sequence: Synthetic oligonucleotide
tggtattcggcaagactatgct

SEQ ID NO: 1633 - DNA, 26 bp, Artificial Sequence
  Description of Artificial Sequence: Synthetic oligonucleotide
tggtattcggcaagactatgctcagg

SEQ ID NO: 1634 - DNA, 30 bp, Artificial Sequence
  Description of Artificial Sequence: Synthetic oligonucleotide
tggtattcggcaagactatgctcaggtcct

SEQ ID NO: 1635 - DNA, 34 bp, Artificial Sequence
  Description of Artificial Sequence: Synthetic oligonucleotide
tggtattcggcaagactatgctcaggtcctactt

SEQ ID NO: 1636 - DNA, 38 bp, Artificial Sequence
  Description of Artificial Sequence: Synthetic oligonucleotide
tggtattcggcaagactatgctcaggtcctacttctga

SEQ ID NO: 1637 - DNA, 40 bp, Artificial Sequence
  Description of Artificial Sequence: Synthetic oligonucleotide
tgtcacaattcagaagtaggacctgagcatagtcttgccg

SEQ ID NO: 1638 - DNA, 23 bp, Artificial Sequence
  Description of Artificial Sequence: Synthetic oligonucleotide
ttatggtattcggcaagactatg

SEQ ID NO: 1639 - DNA, 27 bp, Artificial Sequence
  Description of Artificial Sequence: Synthetic oligonucleotide
ttatggtattcggcaagactatgctca

SEQ ID NO: 1640 - DNA, 31 bp, Artificial Sequence
  Description of Artificial Sequence: Synthetic oligonucleotide
ttatggtattcggcaagactatgctcaggtc

SEQ ID NO: 1641 - DNA, 35 bp, Artificial Sequence
  Description of Artificial Sequence: Synthetic oligonucleotide
ttatggtattcggcaagactatgctcaggtcctac

SEQ ID NO: 1642 - DNA, 39 bp, Artificial Sequence
  Description of Artificial Sequence: Synthetic oligonucleotide
ttatggtattcggcaagactatgctcaggtcctacttct

SEQ ID NO: 1643 - DNA, 37 bp, Artificial Sequence
  Description of Artificial Sequence: Synthetic oligonucleotide
ttcaagccagattcattatggtattcggcaagactat

SEQ ID NO: 1644 - DNA, 32 bp, Artificial Sequence
  Description of Artificial Sequence: Synthetic oligonucleotide
ttcagaagtaggacctgagcatagtcttgccg

SEQ ID NO: 1645 - DNA, 36 bp, Artificial Sequence
  Description of Artificial Sequence: Synthetic oligonucleotide
ttcagaagtaggacctgagcatagtcttgccgaata

SEQ ID NO: 1646 - DNA, 40 bp, Artificial Sequence
  Description of Artificial Sequence: Synthetic oligonucleotide
ttcagaagtaggacctgagcatagtcttgccgaataccat

SEQ ID NO: 1647 - DNA, 27 bp, Artificial Sequence
  Description of Artificial Sequence: Synthetic oligonucleotide
ttcattatggtattcggcaagactatg

SEQ ID NO: 1648 - DNA, 31 bp, Artificial Sequence
  Description of Artificial Sequence: Synthetic oligonucleotide
ttcattatggtattcggcaagactatgctca

SEQ ID NO: 1649 - DNA, 35 bp, Artificial Sequence
  Description of Artificial Sequence: Synthetic oligonucleotide
ttcattatggtattcggcaagactatgctcaggtc

SEQ ID NO: 1650 - DNA, 39 bp, Artificial Sequence
  Description of Artificial Sequence: Synthetic oligonucleotide
ttcattatggtattcggcaagactatgctcaggtcctac

SEQ ID NO: 1651 - DNA, 14 bp, Artificial Sequence
  Description of Artificial Sequence: Synthetic oligonucleotide
ttcggcaagactat

SEQ ID NO: 1652 - DNA, 18 bp, Artificial Sequence
  Description of Artificial Sequence: Synthetic oligonucleotide
ttcggcaagactatgctc

SEQ ID NO: 1653 - DNA, 22 bp, Artificial Sequence
  Description of Artificial Sequence: Synthetic oligonucleotide
ttcggcaagactatgctcaggt

SEQ ID NO: 1654 - DNA, 26 bp, Artificial Sequence
  Description of Artificial Sequence: Synthetic oligonucleotide
ttcggcaagactatgctcaggtccta

SEQ ID NO: 1655 - DNA, 30 bp, Artificial Sequence
  Description of Artificial Sequence: Synthetic oligonucleotide
ttcggcaagactatgctcaggtcctacttc

SEQ ID NO: 1656 - DNA, 34 bp, Artificial Sequence
  Description of Artificial Sequence: Synthetic oligonucleotide
ttcggcaagactatgctcaggtcctacttctgaa

SEQ ID NO: 1657 - DNA, 38 bp, Artificial Sequence
  Description of Artificial Sequence: Synthetic oligonucleotide
ttcggcaagactatgctcaggtcctacttctgaattgt

SEQ ID NO: 1658 - DNA, 38 bp, Artificial Sequence
  Description of Artificial Sequence: Synthetic oligonucleotide
tttcaagccagattcattatggtattcggcaagactat

SEQ ID NO: 1659 - DNA, 38 bp, Artificial Sequence
  Description of Artificial Sequence: Synthetic oligonucleotide
ttttcaagccagattcattatggtattcggcaagacta

SEQ ID NO: 1660 - DNA, 38 bp, Artificial Sequence
  Description of Artificial Sequence: Synthetic oligonucleotide
aaaaggctgagagacatattcaaaagtgcaattattcg

SEQ ID NO: 1661 - DNA, 17 bp, Artificial Sequence
  Description of Artificial Sequence: Synthetic oligonucleotide
aaaagtgcaattattcg

SEQ ID NO: 1662 - DNA, 21 bp, Artificial Sequence
  Description of Artificial Sequence: Synthetic oligonucleotide
aaaagtgcaattattcgcact

SEQ ID NO: 1663 - DNA, 25 bp, Artificial Sequence
  Description of Artificial Sequence: Synthetic oligonucleotide
aaaagtgcaattattcgcactagaa

SEQ ID NO: 1664 - DNA, 29 bp, Artificial Sequence
  Description of Artificial Sequence: Synthetic oligonucleotide
aaaagtgcaattattcgcactagaataaa

SEQ ID NO: 1665 - DNA, 33 bp, Artificial Sequence
  Description of Artificial Sequence: Synthetic oligonucleotide
aaaagtgcaattattcgcactagaataaactct

SEQ ID NO: 1666 - DNA, 37 bp, Artificial Sequence
  Description of Artificial Sequence: Synthetic oligonucleotide
aaaagtgcaattattcgcactagaataaactctgaac

SEQ ID NO: 1667 - DNA, 36 bp, Artificial Sequence
  Description of Artificial Sequence: Synthetic oligonucleotide
aaaggctgagagacatattcaaaagtgcaattattc

SEQ ID NO: 1668 - DNA, 40 bp, Artificial Sequence
  Description of Artificial Sequence: Synthetic oligonucleotide
aaaggctgagagacatattcaaaagtgcaattattcgcac

SEQ ID NO: 1669 - DNA, 16 bp, Artificial Sequence
  Description of Artificial Sequence: Synthetic oligonucleotide
aaagtgcaattattcg

SEQ ID NO: 1670 - DNA, 20 bp, Artificial Sequence
  Description of Artificial Sequence: Synthetic oligonucleotide
aaagtgcaattattcgcact

SEQ ID NO: 1671 - DNA, 24 bp, Artificial Sequence
  Description of Artificial Sequence: Synthetic oligonucleotide
aaagtgcaattattcgcactagaa

SEQ ID NO: 1672 - DNA, 28 bp, Artificial Sequence
  Description of Artificial Sequence: Synthetic oligonucleotide
aaagtgcaattattcgcactagaataaa

SEQ ID NO: 1673 - DNA, 32 bp, Artificial Sequence
  Description of Artificial Sequence: Synthetic oligonucleotide
aaagtgcaattattcgcactagaataaactct

SEQ ID NO: 1674 - DNA, 36 bp, Artificial Sequence
  Description of Artificial Sequence: Synthetic oligonucleotide
aaagtgcaattattcgcactagaataaactctgaac

SEQ ID NO: 1675 - DNA, 40 bp, Artificial Sequence
  Description of Artificial Sequence: Synthetic oligonucleotide
aaagtgcaattattcgcactagaataaactctgaactcac

SEQ ID NO: 1676 - DNA, 37 bp, Artificial Sequence
  Description of Artificial Sequence: Synthetic oligonucleotide
aaggctgagagacatattcaaaagtgcaattattcgc

SEQ ID NO: 1677 - DNA, 37 bp, Artificial Sequence
  Description of Artificial Sequence: Synthetic oligonucleotide
aagtgagttcagagtttattctagtgcgaataattgc

SEQ ID NO: 1678 - DNA, 16 bp, Artificial Sequence
  Description of Artificial Sequence: Synthetic oligonucleotide
aagtgcaattattcgc

SEQ ID NO: 1679 - DNA, 20 bp, Artificial Sequence
  Description of Artificial Sequence: Synthetic oligonucleotide
aagtgcaattattcgcacta

SEQ ID NO: 1680 - DNA, 24 bp, Artificial Sequence
  Description of Artificial Sequence: Synthetic oligonucleotide
aagtgcaattattcgcactagaat

SEQ ID NO: 1681 - DNA, 28 bp, Artificial Sequence
  Description of Artificial Sequence: Synthetic oligonucleotide
aagtgcaattattcgcactagaataaac

SEQ ID NO: 1682 - DNA, 32 bp, Artificial Sequence
  Description of Artificial Sequence: Synthetic oligonucleotide
aagtgcaattattcgcactagaataaactctg

SEQ ID NO: 1683 - DNA, 36 bp, Artificial Sequence
  Description of Artificial Sequence: Synthetic oligonucleotide
aagtgcaattattcgcactagaataaactctgaact

SEQ ID NO: 1684 - DNA, 40 bp, Artificial Sequence
  Description of Artificial Sequence: Synthetic oligonucleotide
aagtgcaattattcgcactagaataaactctgaactcact

SEQ ID NO: 1685 - DNA, 27 bp, Artificial Sequence
  Description of Artificial Sequence: Synthetic oligonucleotide
acatattcaaaagtgcaattattcgca

SEQ ID NO: 1686 - DNA, 31 bp, Artificial Sequence
  Description of Artificial Sequence: Synthetic oligonucleotide
acatattcaaaagtgcaattattcgcactag

SEQ ID NO: 1687 - DNA, 35 bp, Artificial Sequence
  Description of Artificial Sequence: Synthetic oligonucleotide
acatattcaaaagtgcaattattcgcactagaata

SEQ ID NO: 1688 - DNA, 39 bp, Artificial Sequence
  Description of Artificial Sequence: Synthetic oligonucleotide
acatattcaaaagtgcaattattcgcactagaataaact

SEQ ID NO: 1689 - DNA, 26 bp, Artificial Sequence
  Description of Artificial Sequence: Synthetic oligonucleotide
agacatattcaaaagtgcaattattc

SEQ ID NO: 1690 - DNA, 30 bp, Artificial Sequence
  Description of Artificial Sequence: Synthetic oligonucleotide
agacatattcaaaagtgcaattattcgcac

SEQ ID NO: 1691 - DNA, 34 bp, Artificial Sequence
  Description of Artificial Sequence: Synthetic oligonucleotide
agacatattcaaaagtgcaattattcgcactaga

SEQ ID NO: 1692 - DNA, 38 bp, Artificial Sequence
  Description of Artificial Sequence: Synthetic oligonucleotide
agacatattcaaaagtgcaattattcgcactagaataa

SEQ ID NO: 1693 - DNA, 29 bp, Artificial Sequence
  Description of Artificial Sequence: Synthetic oligonucleotide
agagacatattcaaaagtgcaattattcg

SEQ ID NO: 1694 - DNA, 33 bp, Artificial Sequence
  Description of Artificial Sequence: Synthetic oligonucleotide
agagacatattcaaaagtgcaattattcgcact

SEQ ID NO: 1695 - DNA, 37 bp, Artificial Sequence
  Description of Artificial Sequence: Synthetic oligonucleotide
agagacatattcaaaagtgcaattattcgcactagaa

SEQ ID NO: 1696 - DNA, 27 bp, Artificial Sequence
  Description of Artificial Sequence: Synthetic oligonucleotide
agagtttattctagtgcgaataattgc

SEQ ID NO: 1697 - DNA, 36 bp, Artificial Sequence
  Description of Artificial Sequence: Synthetic oligonucleotide
aggctgagagacatattcaaaagtgcaattattcgc

SEQ ID NO: 1698 - DNA, 40 bp, Artificial Sequence
  Description of Artificial Sequence: Synthetic oligonucleotide
aggctgagagacatattcaaaagtgcaattattcgcacta

SEQ ID NO: 1699 - DNA, 15 bp, Artificial Sequence
  Description of Artificial Sequence: Synthetic oligonucleotide
agtgcaattattcgc

SEQ ID NO: 1700 - DNA, 19 bp, Artificial Sequence
  Description of Artificial Sequence: Synthetic oligonucleotide
agtgcaattattcgcacta

SEQ ID NO: 1701 - DNA, 23 bp, Artificial Sequence
  Description of Artificial Sequence: Synthetic oligonucleotide
agtgcaattattcgcactagaat

SEQ ID NO: 1702 - DNA, 27 bp, Artificial Sequence
  Description of Artificial Sequence: Synthetic oligonucleotide
agtgcaattattcgcactagaataaac

SEQ ID NO: 1703 - DNA, 31 bp, Artificial Sequence
  Description of Artificial Sequence: Synthetic oligonucleotide
agtgcaattattcgcactagaataaactctg

SEQ ID NO: 1704 - DNA, 35 bp, Artificial Sequence
  Description of Artificial Sequence: Synthetic oligonucleotide
agtgcaattattcgcactagaataaactctgaact

SEQ ID NO: 1705 - DNA, 39 bp, Artificial Sequence
  Description of Artificial Sequence: Synthetic oligonucleotide
agtgcaattattcgcactagaataaactctgaactcact

SEQ ID NO: 1706 - DNA, 32 bp, Artificial Sequence
  Description of Artificial Sequence: Synthetic oligonucleotide
agttcagagtttattctagtgcgaataattgc

SEQ ID NO: 1707 - DNA, 22 bp, Artificial Sequence
  Description of Artificial Sequence: Synthetic oligonucleotide
atattcaaaagtgcaattattc

SEQ ID NO: 1708 - DNA, 26 bp, Artificial Sequence
  Description of Artificial Sequence: Synthetic oligonucleotide
atattcaaaagtgcaattattcgcac

SEQ ID NO: 1709 - DNA, 30 bp, Artificial Sequence
  Description of Artificial Sequence: Synthetic oligonucleotide
atattcaaaagtgcaattattcgcactaga

SEQ ID NO: 1710 - DNA, 34 bp, Artificial Sequence
  Description of Artificial Sequence: Synthetic oligonucleotide
atattcaaaagtgcaattattcgcactagaataa

SEQ ID NO: 1711 - DNA, 38 bp, Artificial Sequence
  Description of Artificial Sequence: Synthetic oligonucleotide
atattcaaaagtgcaattattcgcactagaataaactc

SEQ ID NO: 1712 - DNA, 21 bp, Artificial Sequence
  Description of Artificial Sequence: Synthetic oligonucleotide
attcaaaagtgcaattattcg

SEQ ID NO: 1713 - DNA, 25 bp, Artificial Sequence
  Description of Artificial Sequence: Synthetic oligonucleotide
attcaaaagtgcaattattcgcact

SEQ ID NO: 1714 - DNA, 29 bp, Artificial Sequence
  Description of Artificial Sequence: Synthetic oligonucleotide
attcaaaagtgcaattattcgcactagaa

SEQ ID NO: 1715 - DNA, 33 bp, Artificial Sequence
  Description of Artificial Sequence: Synthetic oligonucleotide
attcaaaagtgcaattattcgcactagaataaa

SEQ ID NO: 1716 - DNA, 37 bp, Artificial Sequence
  Description of Artificial Sequence: Synthetic oligonucleotide
attcaaaagtgcaattattcgcactagaataaactct

SEQ ID NO: 1717 - DNA, 20 bp, Artificial Sequence
  Description of Artificial Sequence: Synthetic oligonucleotide
attctagtgcgaataattgc

SEQ ID NO: 1718 - DNA, 19 bp, Artificial Sequence
  Description of Artificial Sequence: Synthetic oligonucleotide
caaaagtgcaattattcgc

SEQ ID NO: 1719 - DNA, 23 bp, Artificial Sequence
  Description of Artificial Sequence: Synthetic oligonucleotide
caaaagtgcaattattcgcacta

SEQ ID NO: 1720 - DNA, 27 bp, Artificial Sequence
  Description of Artificial Sequence: Synthetic oligonucleotide
caaaagtgcaattattcgcactagaat

SEQ ID NO: 1721 - DNA, 31 bp, Artificial Sequence
  Description of Artificial Sequence: Synthetic oligonucleotide
caaaagtgcaattattcgcactagaataaac

SEQ ID NO: 1722 - DNA, 35 bp, Artificial Sequence
  Description of Artificial Sequence: Synthetic oligonucleotide
caaaagtgcaattattcgcactagaataaactctg

SEQ ID NO: 1723 - DNA, 39 bp, Artificial Sequence
  Description of Artificial Sequence: Synthetic oligonucleotide
caaaagtgcaattattcgcactagaataaactctgaact

SEQ ID NO: 1724 - DNA, 23 bp, Artificial Sequence
  Description of Artificial Sequence: Synthetic oligonucleotide
catattcaaaagtgcaattattc

SEQ ID NO: 1725 - DNA, 27 bp, Artificial Sequence
  Description of Artificial Sequence: Synthetic oligonucleotide
catattcaaaagtgcaattattcgcac

SEQ ID NO: 1726 - DNA, 31 bp, Artificial Sequence
  Description of Artificial Sequence: Synthetic oligonucleotide
catattcaaaagtgcaattattcgcactaga

SEQ ID NO: 1727 - DNA, 35 bp, Artificial Sequence
  Description of Artificial Sequence: Synthetic oligonucleotide
catattcaaaagtgcaattattcgcactagaataa

SEQ ID NO: 1728 - DNA, 39 bp, Artificial Sequence
  Description of Artificial Sequence: Synthetic oligonucleotide
catattcaaaagtgcaattattcgcactagaataaactc

SEQ ID NO: 1729 - DNA, 15 bp, Artificial Sequence
  Description of Artificial Sequence: Synthetic oligonucleotide
cgaataattgcactt

SEQ ID NO: 1730 - DNA, 19 bp, Artificial Sequence
  Description of Artificial Sequence: Synthetic oligonucleotide
cgaataattgcacttttga

SEQ ID NO: 1731 - DNA, 23 bp, Artificial Sequence
  Description of Artificial Sequence: Synthetic oligonucleotide
cgaataattgcacttttgaatat

SEQ ID NO: 1732 - DNA, 27 bp, Artificial Sequence
  Description of Artificial Sequence: Synthetic oligonucleotide
cgaataattgcacttttgaatatgtct

SEQ ID NO: 1733 - DNA, 31 bp, Artificial Sequence
  Description of Artificial Sequence: Synthetic oligonucleotide
cgaataattgcacttttgaatatgtctctca

SEQ ID NO: 1734 - DNA, 35 bp, Artificial Sequence
  Description of Artificial Sequence: Synthetic oligonucleotide
cgaataattgcacttttgaatatgtctctcagcct

SEQ ID NO: 1735 - DNA, 39 bp, Artificial Sequence
  Description of Artificial Sequence: Synthetic oligonucleotide
cgaataattgcacttttgaatatgtctctcagccttttc

SEQ ID NO: 1736 - DNA, 31 bp, Artificial Sequence
  Description of Artificial Sequence: Synthetic oligonucleotide
ctgagagacatattcaaaagtgcaattattc

SEQ ID NO: 1737 - DNA, 35 bp, Artificial Sequence
  Description of Artificial Sequence: Synthetic oligonucleotide
ctgagagacatattcaaaagtgcaattattcgcac

SEQ ID NO: 1738 - DNA, 39 bp, Artificial Sequence
  Description of Artificial Sequence: Synthetic oligonucleotide
ctgagagacatattcaaaagtgcaattattcgcactaga

SEQ ID NO: 1739 - DNA, 21 bp, Artificial Sequence
  Description of Artificial Sequence: Synthetic oligonucleotide
tattcaaaagtgcaattattc

SEQ ID NO: 1740 - DNA, 25 bp, Artificial Sequence
  Description of Artificial Sequence: Synthetic oligonucleotide
tattcaaaagtgcaattattcgcac

SEQ ID NO: 1741 - DNA, 29 bp, Artificial Sequence
  Description of Artificial Sequence: Synthetic oligonucleotide
tattcaaaagtgcaattattcgcactaga

SEQ ID NO: 1742 - DNA, 33 bp, Artificial Sequence
  Description of Artificial Sequence: Synthetic oligonucleotide
tattcaaaagtgcaattattcgcactagaataa

SEQ ID NO: 1743 - DNA, 37 bp, Artificial Sequence
  Description of Artificial Sequence: Synthetic oligonucleotide
tattcaaaagtgcaattattcgcactagaataaactc

SEQ ID NO: 1744 - DNA, 21 bp, Artificial Sequence
  Description of Artificial Sequence: Synthetic oligonucleotide
tattctagtgcgaataattgc

SEQ ID NO: 1745 - DNA, 20 bp, Artificial Sequence
  Description of Artificial Sequence: Synthetic oligonucleotide
tcaaaagtgcaattattcgc

SEQ ID NO: 1746 - DNA, 24 bp, Artificial Sequence
  Description of Artificial Sequence: Synthetic oligonucleotide
tcaaaagtgcaattattcgcacta

SEQ ID NO: 1747 - DNA, 28 bp, Artificial Sequence
  Description of Artificial Sequence: Synthetic oligonucleotide
tcaaaagtgcaattattcgcactagaat

SEQ ID NO: 1748 - DNA, 32 bp, Artificial Sequence
  Description of Artificial Sequence: Synthetic oligonucleotide
tcaaaagtgcaattattcgcactagaataaac

SEQ ID NO: 1749 - DNA, 36 bp, Artificial Sequence
  Description of Artificial Sequence: Synthetic oligonucleotide
tcaaaagtgcaattattcgcactagaataaactctg

SEQ ID NO: 1750 - DNA, 40 bp, Artificial Sequence
  Description of Artificial Sequence: Synthetic oligonucleotide
tcaaaagtgcaattattcgcactagaataaactctgaact

SEQ ID NO: 1751 - DNA, 19 bp, Artificial Sequence
  Description of Artificial Sequence: Synthetic oligonucleotide
tctagtgcgaataattgca

SEQ ID NO: 1752 - DNA, 33 bp, Artificial Sequence
  Description of Artificial Sequence: Synthetic oligonucleotide
tgagagacatattcaaaagtgcaattattcgca

SEQ ID NO: 1753 - DNA, 37 bp, Artificial Sequence
  Description of Artificial Sequence: Synthetic oligonucleotide
tgagagacatattcaaaagtgcaattattcgcactag

SEQ ID NO: 1754 - DNA, 34 bp, Artificial Sequence
  Description of Artificial Sequence: Synthetic oligonucleotide
tgagttcagagtttattctagtgcgaataattgc

SEQ ID NO: 1755 - DNA, 15 bp, Artificial Sequence
  Description of Artificial Sequence: Synthetic oligonucleotide
tgcaattattcgcac

SEQ ID NO: 1756 - DNA, 19 bp, Artificial Sequence
  Description of Artificial Sequence: Synthetic oligonucleotide
tgcaattattcgcactaga

SEQ ID NO: 1757 - DNA, 23 bp, Artificial Sequence
  Description of Artificial Sequence: Synthetic oligonucleotide
tgcaattattcgcactagaataa

SEQ ID NO: 1758 - DNA, 27 bp, Artificial Sequence
  Description of Artificial Sequence: Synthetic oligonucleotide
tgcaattattcgcactagaataaactc

SEQ ID NO: 1759 - DNA, 31 bp, Artificial Sequence
  Description of Artificial Sequence: Synthetic oligonucleotide
tgcaattattcgcactagaataaactctgaa

SEQ ID NO: 1760 - DNA, 35 bp, Artificial Sequence
  Description of Artificial Sequence: Synthetic oligonucleotide
tgcaattattcgcactagaataaactctgaactca

SEQ ID NO: 1761 - DNA, 39 bp, Artificial Sequence
  Description of Artificial Sequence: Synthetic oligonucleotide
tgcaattattcgcactagaataaactctgaactcacttt

SEQ ID NO: 1762 - DNA, 15 bp, Artificial Sequence
  Description of Artificial Sequence: Synthetic oligonucleotide
tgcgaataattgcac

SEQ ID NO: 1763 - DNA, 19 bp, Artificial Sequence
  Description of Artificial Sequence: Synthetic oligonucleotide
tgcgaataattgcactttt

SEQ ID NO: 1764 - DNA, 23 bp, Artificial Sequence
  Description of Artificial Sequence: Synthetic oligonucleotide
tgcgaataattgcacttttgaat

SEQ ID NO: 1765 - DNA, 27 bp, Artificial Sequence
  Description of Artificial Sequence: Synthetic oligonucleotide
tgcgaataattgcacttttgaatatgt

SEQ ID NO: 1766 - DNA, 31 bp, Artificial Sequence
  Description of Artificial Sequence: Synthetic oligonucleotide
tgcgaataattgcacttttgaatatgtctct

SEQ ID NO: 1767 - DNA, 35 bp, Artificial Sequence
  Description of Artificial Sequence: Synthetic oligonucleotide
tgcgaataattgcacttttgaatatgtctctcagc

SEQ ID NO: 1768 - DNA, 39 bp, Artificial Sequence
  Description of Artificial Sequence: Synthetic oligonucleotide
tgcgaataattgcacttttgaatatgtctctcagccttt

SEQ ID NO: 1769 - DNA, 19 bp, Artificial Sequence
  Description of Artificial Sequence: Synthetic oligonucleotide
ttcaaaagtgcaattattc

SEQ ID NO: 1770 - DNA, 23 bp, Artificial Sequence
  Description of Artificial Sequence: Synthetic oligonucleotide
ttcaaaagtgcaattattcgcac

SEQ ID NO: 1771 - DNA, 27 bp, Artificial Sequence
  Description of Artificial Sequence: Synthetic oligonucleotide
ttcaaaagtgcaattattcgcactaga

SEQ ID NO: 1772 - DNA, 31 bp, Artificial Sequence
  Description of Artificial Sequence: Synthetic oligonucleotide
ttcaaaagtgcaattattcgcactagaataa

SEQ ID NO: 1773 - DNA, 35 bp, Artificial Sequence
  Description of Artificial Sequence: Synthetic oligonucleotide
ttcaaaagtgcaattattcgcactagaataaactc

SEQ ID NO: 1774 - DNA, 39 bp, Artificial Sequence
  Description of Artificial Sequence: Synthetic oligonucleotide
ttcaaaagtgcaattattcgcactagaataaactctgaa

SEQ ID NO: 1775 - DNA, 19 bp, Artificial Sequence
  Description of Artificial Sequence: Synthetic oligonucleotide
ttctagtgcgaataattgc

SEQ ID NO: 1776 - DNA, 19 bp, Artificial Sequence
  Description of Artificial Sequence: Synthetic oligonucleotide
aaccagaatggagaacgca

SEQ ID NO: 1777 - DNA, 23 bp, Artificial Sequence
  Description of Artificial Sequence: Synthetic oligonucleotide
aaccagaatggagaacgcagtgg

SEQ ID NO: 1778 - DNA, 31 bp, Artificial Sequence
  Description of Artificial Sequence: Synthetic oligonucleotide
aactggcagtaaccagaatggagaacgcagt

SEQ ID NO: 1779 - DNA, 14 bp, Artificial Sequence
  Description of Artificial Sequence: Synthetic oligonucleotide
aatggagaacgcag

SEQ ID NO: 1780 - DNA, 18 bp, Artificial Sequence
  Description of Artificial Sequence: Synthetic oligonucleotide
aatggagaacgcagtggg

SEQ ID NO: 1781 - DNA, 21 bp, Artificial Sequence
  Description of Artificial Sequence: Synthetic oligonucleotide
accagaatggagaacgcagtg

SEQ ID NO: 1782 - DNA, 13 bp, Artificial Sequence
  Description of Artificial Sequence: Synthetic oligonucleotide
actgcgttctcca

SEQ ID NO: 1783 - DNA, 17 bp, Artificial Sequence
  Description of Artificial Sequence: Synthetic oligonucleotide
actgcgttctccattct

SEQ ID NO: 1784 - DNA, 21 bp, Artificial Sequence
  Description of Artificial Sequence: Synthetic oligonucleotide
actgcgttctccattctggtt

SEQ ID NO: 1785 - DNA, 25 bp, Artificial Sequence
  Description of Artificial Sequence: Synthetic oligonucleotide
actgcgttctccattctggttactg

SEQ ID NO: 1786 - DNA, 29 bp, Artificial Sequence
  Description of Artificial Sequence: Synthetic oligonucleotide
actgcgttctccattctggttactgccag

SEQ ID NO: 1787 - DNA, 33 bp, Artificial Sequence
  Description of Artificial Sequence: Synthetic oligonucleotide
actgcgttctccattctggttactgccagttga

SEQ ID NO: 1788 - DNA, 28 bp, Artificial Sequence
  Description of Artificial Sequence: Synthetic oligonucleotide
actggcagtaaccagaatggagaacgca

SEQ ID NO: 1789 - DNA, 32 bp, Artificial Sequence
  Description of Artificial Sequence: Synthetic oligonucleotide
actggcagtaaccagaatggagaacgcagtgg

SEQ ID NO: 1790 - DNA, 18 bp, Artificial Sequence
  Description of Artificial Sequence: Synthetic oligonucleotide
agaatggagaacgcagtg

SEQ ID NO: 1791 - DNA, 36 bp, Artificial Sequence
  Description of Artificial Sequence: Synthetic oligonucleotide
agattcaactggcagtaaccagaatggagaacgcag

SEQ ID NO: 1792 - DNA, 24 bp, Artificial Sequence
  Description of Artificial Sequence: Synthetic oligonucleotide
agtaaccagaatggagaacgcagt

SEQ ID NO: 1793 - DNA, 22 bp, Artificial Sequence
  Description of Artificial Sequence: Synthetic oligonucleotide
atcgcgccccactgcgttctcc

SEQ ID NO: 1794 - DNA, 26 bp, Artificial Sequence
  Description of Artificial Sequence: Synthetic oligonucleotide
atcgcgccccactgcgttctccattc

SEQ ID NO: 1795 - DNA, 15 bp, Artificial Sequence
  Description of Artificial Sequence: Synthetic oligonucleotide
atggagaacgcagtg

SEQ ID NO: 1796 - DNA, 34 bp, Artificial Sequence
  Description of Artificial Sequence: Synthetic oligonucleotide
attcaactggcagtaaccagaatggagaacgcag

SEQ ID NO: 1797 - DNA, 31 bp, Artificial Sequence
  Description of Artificial Sequence: Synthetic oligonucleotide
caactggcagtaaccagaatggagaacgcag

SEQ ID NO: 1798 - DNA, 13 bp, Artificial Sequence
  Description of Artificial Sequence: Synthetic oligonucleotide
cactgcgttctcc

SEQ ID NO: 1799 - DNA, 17 bp, Artificial Sequence
  Description of Artificial Sequence: Synthetic oligonucleotide
cactgcgttctccattc

SEQ ID NO: 1800 - DNA, 21 bp, Artificial Sequence
  Description of Artificial Sequence: Synthetic oligonucleotide
cactgcgttctccattctggt

SEQ ID NO: 1801 - DNA, 25 bp, Artificial Sequence
  Description of Artificial Sequence: Synthetic oligonucleotide
cactgcgttctccattctggttact

SEQ ID NO: 1802 - DNA, 29 bp, Artificial Sequence
  Description of Artificial Sequence: Synthetic oligonucleotide
cactgcgttctccattctggttactgcca

SEQ ID NO: 1803 - DNA, 33 bp, Artificial Sequence
  Description of Artificial Sequence: Synthetic oligonucleotide
cactgcgttctccattctggttactgccagttg

SEQ ID NO: 1804 - DNA, 37 bp, Artificial Sequence
  Description of Artificial Sequence: Synthetic oligonucleotide
cactgcgttctccattctggttactgccagttgaatc

SEQ ID NO: 1805 - DNA, 19 bp, Artificial Sequence
  Description of Artificial Sequence: Synthetic oligonucleotide
cagaatggagaacgcagtg

SEQ ID NO: 1806 - DNA, 37 bp, Artificial Sequence
  Description of Artificial Sequence: Synthetic oligonucleotide
cagattcaactggcagtaaccagaatggagaacgcag

SEQ ID NO: 1807 - DNA, 25 bp, Artificial Sequence
  Description of Artificial Sequence: Synthetic oligonucleotide
cagtaaccagaatggagaacgcagt

SEQ ID NO: 1808 - DNA, 14 bp, Artificial Sequence
  Description of Artificial Sequence: Synthetic oligonucleotide
ccactgcgttctcc

SEQ ID NO: 1809 - DNA, 18 bp, Artificial Sequence
  Description of Artificial Sequence: Synthetic oligonucleotide
ccactgcgttctccattc

SEQ ID NO: 1810 - DNA, 22 bp, Artificial Sequence
  Description of Artificial Sequence: Synthetic oligonucleotide
ccactgcgttctccattctggt

SEQ ID NO: 1811 - DNA, 26 bp, Artificial Sequence
  Description of Artificial Sequence: Synthetic oligonucleotide
ccactgcgttctccattctggttact

SEQ ID NO: 1812 - DNA, 30 bp, Artificial Sequence
  Description of Artificial Sequence: Synthetic oligonucleotide
ccactgcgttctccattctggttactgcca

SEQ ID NO: 1813 - DNA, 34 bp, Artificial Sequence
  Description of Artificial Sequence: Synthetic oligonucleotide
ccactgcgttctccattctggttactgccagttg

SEQ ID NO: 1814 - DNA, 17 bp, Artificial Sequence
  Description of Artificial Sequence: Synthetic oligonucleotide
ccagaatggagaacgca

SEQ ID NO: 1815 - DNA, 21 bp, Artificial Sequence
  Description of Artificial Sequence: Synthetic oligonucleotide
ccagaatggagaacgcagtgg

SEQ ID NO: 1816 - DNA, 17 bp, Artificial Sequence
  Description of Artificial Sequence: Synthetic oligonucleotide
cccactgcgttctccat

SEQ ID NO: 1817 - DNA, 21 bp, Artificial Sequence
  Description of Artificial Sequence: Synthetic oligonucleotide
cccactgcgttctccattctg

SEQ ID NO: 1818 - DNA, 25 bp, Artificial Sequence
  Description of Artificial Sequence: Synthetic oligonucleotide
cccactgcgttctccattctggtta

SEQ ID NO: 1819 - DNA, 29 bp, Artificial Sequence
  Description of Artificial Sequence: Synthetic oligonucleotide
cccactgcgttctccattctggttactgc

SEQ ID NO: 1820 - DNA, 16 bp, Artificial Sequence
  Description of Artificial Sequence: Synthetic oligonucleotide
ccccactgcgttctcc

SEQ ID NO: 1821 - DNA, 20 bp, Artificial Sequence
  Description of Artificial Sequence: Synthetic oligonucleotide
ccccactgcgttctccattc

SEQ ID NO: 1822 - DNA, 24 bp, Artificial Sequence
  Description of Artificial Sequence: Synthetic oligonucleotide
ccccactgcgttctccattctggt

SEQ ID NO: 1823 - DNA, 28 bp, Artificial Sequence
  Description of Artificial Sequence: Synthetic oligonucleotide
ccccactgcgttctccattctggttact

SEQ ID NO: 1824 - DNA, 19 bp, Artificial Sequence
  Description of Artificial Sequence: Synthetic oligonucleotide
cgccccactgcgttctcca

SEQ ID NO: 1825 - DNA, 23 bp, Artificial Sequence
  Description of Artificial Sequence: Synthetic oligonucleotide
cgccccactgcgttctccattct

SEQ ID NO: 1826 - DNA, 27 bp, Artificial Sequence
  Description of Artificial Sequence: Synthetic oligonucleotide
cgccccactgcgttctccattctggtt

SEQ ID NO: 1827 - DNA, 21 bp, Artificial Sequence
  Description of Artificial Sequence: Synthetic oligonucleotide
cgcgccccactgcgttctcca

SEQ ID NO: 1828 - DNA, 25 bp, Artificial Sequence
  Description of Artificial Sequence: Synthetic oligonucleotide
cgcgccccactgcgttctccattct

SEQ ID NO: 1829 - DNA, 14 bp, Artificial Sequence
  Description of Artificial Sequence: Synthetic oligonucleotide
ctgcgttctccatt

SEQ ID NO: 1830 - DNA, 18 bp, Artificial Sequence
  Description of Artificial Sequence: Synthetic oligonucleotide
ctgcgttctccattctgg

SEQ ID NO: 1831 - DNA, 22 bp, Artificial Sequence
  Description of Artificial Sequence: Synthetic oligonucleotide
ctgcgttctccattctggttac

SEQ ID NO: 1832 - DNA, 26 bp, Artificial Sequence
  Description of Artificial Sequence: Synthetic oligonucleotide
ctgcgttctccattctggttactgcc

SEQ ID NO: 1833 - DNA, 30 bp, Artificial Sequence
  Description of Artificial Sequence: Synthetic oligonucleotide
ctgcgttctccattctggttactgccagtt

SEQ ID NO: 1834 - DNA, 34 bp, Artificial Sequence
  Description of Artificial Sequence: Synthetic oligonucleotide
ctgcgttctccattctggttactgccagttgaat

SEQ ID NO: 1835 - DNA, 39 bp, Artificial Sequence
  Description of Artificial Sequence: Synthetic oligonucleotide
ctgcgttctccattctggttactgccagttgaatctgag

SEQ ID NO: 1836 - DNA, 30 bp, Artificial Sequence
  Description of Artificial Sequence: Synthetic oligonucleotide
ctggcagtaaccagaatggagaacgcagtg

SEQ ID NO: 1837 - DNA, 21 bp, Artificial Sequence
  Description of Artificial Sequence: Synthetic oligonucleotide
taaccagaatggagaacgcag

SEQ ID NO: 1838 - DNA, 25 bp, Artificial Sequence
  Description of Artificial Sequence: Synthetic oligonucleotide
taaccagaatggagaacgcagtggg

SEQ ID NO: 1839 - DNA, 34 bp, Artificial Sequence
  Description of Artificial Sequence: Synthetic oligonucleotide
tcaactggcagtaaccagaatggagaacgcagtg

SEQ ID NO: 1840 - DNA, 24 bp, Artificial Sequence
  Description of Artificial Sequence: Synthetic oligonucleotide
tcgcgccccactgcgttctccatt

SEQ ID NO: 1841 - DNA, 13 bp, Artificial Sequence
  Description of Artificial Sequence: Synthetic oligonucleotide
tgcgttctccatt

SEQ ID NO: 1842 - DNA, 17 bp, Artificial Sequence
  Description of Artificial Sequence: Synthetic oligonucleotide
tgcgttctccattctgg

SEQ ID NO: 1843 - DNA, 21 bp, Artificial Sequence
  Description of Artificial Sequence: Synthetic oligonucleotide
tgcgttctccattctggttac

SEQ ID NO: 1844 - DNA, 25 bp, Artificial Sequence
  Description of Artificial Sequence: Synthetic oligonucleotide
tgcgttctccattctggttactgcc

SEQ ID NO: 1845 - DNA, 29 bp, Artificial Sequence
  Description of Artificial Sequence: Synthetic oligonucleotide
tgcgttctccattctggttactgccagtt

SEQ ID NO: 1846 - DNA, 33 bp, Artificial Sequence
  Description of Artificial Sequence: Synthetic oligonucleotide
tgcgttctccattctggttactgccagttgaat

SEQ ID NO: 1847 - DNA, 38 bp, Artificial Sequence
  Description of Artificial Sequence: Synthetic oligonucleotide
tgcgttctccattctggttactgccagttgaatctgag

SEQ ID NO: 1848 - DNA, 15 bp, Artificial Sequence
  Description of Artificial Sequence: Synthetic oligonucleotide
tggagaacgcagtgg

SEQ ID NO: 1849 - DNA, 28 bp, Artificial Sequence
  Description of Artificial Sequence: Synthetic oligonucleotide
tggcagtaaccagaatggagaacgcagt

SEQ ID NO: 1850 - DNA, 32 bp, Artificial Sequence
  Description of Artificial Sequence: Synthetic oligonucleotide
ttcaactggcagtaaccagaatggagaacgca

SEQ ID NO: 1851 - DNA, 25 bp, Artificial Sequence
  Description of Artificial Sequence: Synthetic oligonucleotide
ttgatcgcgccccactgcgttctcc

SEQ ID NO: 1852 - DNA, 27 bp, Artificial Sequence
  Description of Artificial Sequence: Synthetic oligonucleotide
ttttgatcgcgccccactgcgttctcc

SEQ ID NO: 1853 - DNA, 33 bp, Artificial Sequence
  Description of Artificial Sequence: Synthetic oligonucleotide
aaatcaatactgagtcctctttatgcatttgca

SEQ ID NO: 1854 - DNA, 37 bp, Artificial Sequence
  Description of Artificial Sequence: Synthetic oligonucleotide
aaatcaatactgagtcctctttatgcatttgcatcag

SEQ ID NO: 1855 - DNA, 30 bp, Artificial Sequence
  Description of Artificial Sequence: Synthetic oligonucleotide
aacacgagcagcctctgatgcaaatgcata

SEQ ID NO: 1856 - DNA, 34 bp, Artificial Sequence
  Description of Artificial Sequence: Synthetic oligonucleotide
aacacgagcagcctctgatgcaaatgcataaaga

SEQ ID NO: 1857 - DNA, 37 bp, Artificial Sequence
  Description of Artificial Sequence: Synthetic oligonucleotide
aacagaaatcaatactgagtcctctttatgcatttgc

SEQ ID NO: 1858 - DNA, 26 bp, Artificial Sequence
  Description of Artificial Sequence: Synthetic oligonucleotide
aatactgagtcctctttatgcatttg

SEQ ID NO: 1859 - DNA, 30 bp, Artificial Sequence
  Description of Artificial Sequence: Synthetic oligonucleotide
aatactgagtcctctttatgcatttgcatc

SEQ ID NO: 1860 - DNA, 34 bp, Artificial Sequence
  Description of Artificial Sequence: Synthetic oligonucleotide
aatactgagtcctctttatgcatttgcatcagag

SEQ ID NO: 1861 - DNA, 38 bp, Artificial Sequence
  Description of Artificial Sequence: Synthetic oligonucleotide
aatactgagtcctctttatgcatttgcatcagaggctg

SEQ ID NO: 1862 - DNA, 31 bp, Artificial Sequence
  Description of Artificial Sequence: Synthetic oligonucleotide
aatcaatactgagtcctctttatgcatttgc

SEQ ID NO: 1863 - DNA, 35 bp, Artificial Sequence
  Description of Artificial Sequence: Synthetic oligonucleotide
aatcaatactgagtcctctttatgcatttgcatca

SEQ ID NO: 1864 - DNA, 39 bp, Artificial Sequence
  Description of Artificial Sequence: Synthetic oligonucleotide
aatcaatactgagtcctctttatgcatttgcatcagagg

SEQ ID NO: 1865 - DNA, 34 bp, Artificial Sequence
  Description of Artificial Sequence: Synthetic oligonucleotide
acaacacgagcagcctctgatgcaaatgcataaa

SEQ ID NO: 1866 - DNA, 29 bp, Artificial Sequence
  Description of Artificial Sequence: Synthetic oligonucleotide
acacgagcagcctctgatgcaaatgcata

SEQ ID NO: 1867 - DNA, 33 bp, Artificial Sequence
  Description of Artificial Sequence: Synthetic oligonucleotide
acacgagcagcctctgatgcaaatgcataaaga

SEQ ID NO: 1868 - DNA, 36 bp, Artificial Sequence
  Description of Artificial Sequence: Synthetic oligonucleotide
acagaaatcaatactgagtcctctttatgcatttgc

SEQ ID NO: 1869 - DNA, 40 bp, Artificial Sequence
  Description of Artificial Sequence: Synthetic oligonucleotide
acagaaatcaatactgagtcctctttatgcatttgcatca

SEQ ID NO: 1870 - DNA, 30 bp, Artificial Sequence
  Description of Artificial Sequence: Synthetic oligonucleotide
acgagcagcctctgatgcaaatgcataaag

SEQ ID NO: 1871 - DNA, 34 bp, Artificial Sequence
  Description of Artificial Sequence: Synthetic oligonucleotide
acgagcagcctctgatgcaaatgcataaagagga

SEQ ID NO: 1872 - DNA, 25 bp, Artificial Sequence
  Description of Artificial Sequence: Synthetic oligonucleotide
actgagtcctctttatgcatttgca

SEQ ID NO: 1873 - DNA, 29 bp, Artificial Sequence
  Description of Artificial Sequence: Synthetic oligonucleotide
actgagtcctctttatgcatttgcatcag

SEQ ID NO: 1874 - DNA, 33 bp, Artificial Sequence
  Description of Artificial Sequence: Synthetic oligonucleotide
actgagtcctctttatgcatttgcatcagaggc

SEQ ID NO: 1875 - DNA, 37 bp, Artificial Sequence
  Description of Artificial Sequence: Synthetic oligonucleotide
actgagtcctctttatgcatttgcatcagaggctgct

SEQ ID NO: 1876 - DNA, 34 bp, Artificial Sequence
  Description of Artificial Sequence: Synthetic oligonucleotide
agaaatcaatactgagtcctctttatgcatttgc

SEQ ID NO: 1877 - DNA, 38 bp, Artificial Sequence
  Description of Artificial Sequence: Synthetic oligonucleotide
agaaatcaatactgagtcctctttatgcatttgcatca

SEQ ID NO: 1878 - DNA, 25 bp, Artificial Sequence
  Description of Artificial Sequence: Synthetic oligonucleotide
agcagcctctgatgcaaatgcataa

SEQ ID NO: 1879 - DNA, 29 bp, Artificial Sequence
  Description of Artificial Sequence: Synthetic oligonucleotide
agcagcctctgatgcaaatgcataaagag

SEQ ID NO: 1880 - DNA, 33 bp, Artificial Sequence
  Description of Artificial Sequence: Synthetic oligonucleotide
agcagcctctgatgcaaatgcataaagaggact

SEQ ID NO: 1881 - DNA, 37 bp, Artificial Sequence
  Description of Artificial Sequence: Synthetic oligonucleotide
agcagcctctgatgcaaatgcataaagaggactcagt

SEQ ID NO: 1882 - DNA, 21 bp, Artificial Sequence
  Description of Artificial Sequence: Synthetic oligonucleotide
agcctctgatgcaaatgcata

SEQ ID NO: 1883 - DNA, 25 bp, Artificial Sequence
  Description of Artificial Sequence: Synthetic oligonucleotide
agcctctgatgcaaatgcataaaga

SEQ ID NO: 1884 - DNA, 29 bp, Artificial Sequence
  Description of Artificial Sequence: Synthetic oligonucleotide
agcctctgatgcaaatgcataaagaggac

SEQ ID NO: 1885 - DNA, 33 bp, Artificial Sequence
  Description of Artificial Sequence: Synthetic oligonucleotide
agcctctgatgcaaatgcataaagaggactcag

SEQ ID NO: 1886 - DNA, 37 bp, Artificial Sequence
  Description of Artificial Sequence: Synthetic oligonucleotide
agcctctgatgcaaatgcataaagaggactcagtatt

SEQ ID NO: 1887 - DNA, 19 bp, Artificial Sequence
  Description of Artificial Sequence: Synthetic oligonucleotide
agtcctctttatgcatttg

SEQ ID NO: 1888 - DNA, 23 bp, Artificial Sequence
  Description of Artificial Sequence: Synthetic oligonucleotide
agtcctctttatgcatttgcatc

SEQ ID NO: 1889 - DNA, 27 bp, Artificial Sequence
  Description of Artificial Sequence: Synthetic oligonucleotide
agtcctctttatgcatttgcatcagag

SEQ ID NO: 1890 - DNA, 31 bp, Artificial Sequence
  Description of Artificial Sequence: Synthetic oligonucleotide
agtcctctttatgcatttgcatcagaggctg

SEQ ID NO: 1891 - DNA, 35 bp, Artificial Sequence
  Description of Artificial Sequence: Synthetic oligonucleotide
agtcctctttatgcatttgcatcagaggctgctcg

SEQ ID NO: 1892 - DNA, 25 bp, Artificial Sequence
  Description of Artificial Sequence: Synthetic oligonucleotide
atactgagtcctctttatgcatttg

SEQ ID NO: 1893 - DNA, 29 bp, Artificial Sequence
  Description of Artificial Sequence: Synthetic oligonucleotide
atactgagtcctctttatgcatttgcatc

SEQ ID NO: 1894 - DNA, 33 bp, Artificial Sequence
  Description of Artificial Sequence: Synthetic oligonucleotide
atactgagtcctctttatgcatttgcatcagag

SEQ ID NO: 1895 - DNA, 37 bp, Artificial Sequence
  Description of Artificial Sequence: Synthetic oligonucleotide
atactgagtcctctttatgcatttgcatcagaggctg

SEQ ID NO: 1896 - DNA, 29 bp, Artificial Sequence
  Description of Artificial Sequence: Synthetic oligonucleotide
atcaatactgagtcctctttatgcatttg

SEQ ID NO: 1897 - DNA, 33 bp, Artificial Sequence
  Description of Artificial Sequence: Synthetic oligonucleotide
atcaatactgagtcctctttatgcatttgcatc

SEQ ID NO: 1898 - DNA, 37 bp, Artificial Sequence
  Description of Artificial Sequence: Synthetic oligonucleotide
atcaatactgagtcctctttatgcatttgcatcagag

SEQ ID NO: 1899 - DNA, 37 bp, Artificial Sequence
  Description of Artificial Sequence: Synthetic oligonucleotide
atcgtacaacacgagcagcctctgatgcaaatgcata

SEQ ID NO: 1900 - DNA, 15 bp, Artificial Sequence
  Description of Artificial Sequence: Synthetic oligonucleotide
atgcaaatgcataaa

SEQ ID NO: 1901 - DNA, 19 bp, Artificial Sequence
  Description of Artificial Sequence: Synthetic oligonucleotide
atgcaaatgcataaagagg

SEQ ID NO: 1902 - DNA, 23 bp, Artificial Sequence
  Description of Artificial Sequence: Synthetic oligonucleotide
atgcaaatgcataaagaggactc

SEQ ID NO: 1903 - DNA, 27 bp, Artificial Sequence
  Description of Artificial Sequence: Synthetic oligonucleotide
atgcaaatgcataaagaggactcagta

SEQ ID NO: 1904 - DNA, 31 bp, Artificial Sequence
  Description of Artificial Sequence: Synthetic oligonucleotide
atgcaaatgcataaagaggactcagtattga

SEQ ID NO: 1905 - DNA, 35 bp, Artificial Sequence
  Description of Artificial Sequence: Synthetic oligonucleotide
atgcaaatgcataaagaggactcagtattgatttc

SEQ ID NO: 1906 - DNA, 17 bp, Artificial Sequence
  Description of Artificial Sequence: Synthetic oligonucleotide
caaatgcataaagagga

SEQ ID NO: 1907 - DNA, 21 bp, Artificial Sequence
  Description of Artificial Sequence: Synthetic oligonucleotide
caaatgcataaagaggactca

SEQ ID NO: 1908 - DNA, 25 bp, Artificial Sequence
  Description of Artificial Sequence: Synthetic oligonucleotide
caaatgcataaagaggactcagtat

SEQ ID NO: 1909 - DNA, 29 bp, Artificial Sequence
  Description of Artificial Sequence: Synthetic oligonucleotide
caaatgcataaagaggactcagtattgat

SEQ ID NO: 1910 - DNA, 31 bp, Artificial Sequence
  Description of Artificial Sequence: Synthetic oligonucleotide
caacacgagcagcctctgatgcaaatgcata

SEQ ID NO: 1911 - DNA, 35 bp, Artificial Sequence
  Description of Artificial Sequence: Synthetic oligonucleotide
caacacgagcagcctctgatgcaaatgcataaaga

SEQ ID NO: 1912 - DNA, 28 bp, Artificial Sequence
  Description of Artificial Sequence: Synthetic oligonucleotide
caatactgagtcctctttatgcatttgc

SEQ ID NO: 1913 - DNA, 32 bp, Artificial Sequence
  Description of Artificial Sequence: Synthetic oligonucleotide
caatactgagtcctctttatgcatttgcatca

SEQ ID NO: 1914 - DNA, 36 bp, Artificial Sequence
  Description of Artificial Sequence: Synthetic oligonucleotide
caatactgagtcctctttatgcatttgcatcagagg

SEQ ID NO: 1915 - DNA, 40 bp, Artificial Sequence
  Description of Artificial Sequence: Synthetic oligonucleotide
caatactgagtcctctttatgcatttgcatcagaggctgc

SEQ ID NO: 1916 - DNA, 31 bp, Artificial Sequence
  Description of Artificial Sequence: Synthetic oligonucleotide
cacgagcagcctctgatgcaaatgcataaag

SEQ ID NO: 1917 - DNA, 35 bp, Artificial Sequence
  Description of Artificial Sequence: Synthetic oligonucleotide
cacgagcagcctctgatgcaaatgcataaagagga

SEQ ID NO: 1918 - DNA, 37 bp, Artificial Sequence
  Description of Artificial Sequence: Synthetic oligonucleotide
cagaaatcaatactgagtcctctttatgcatttgcat

SEQ ID NO: 1919 - DNA, 22 bp, Artificial Sequence
  Description of Artificial Sequence: Synthetic oligonucleotide
cagcctctgatgcaaatgcata

SEQ ID NO: 1920 - DNA, 26 bp, Artificial Sequence
  Description of Artificial Sequence: Synthetic oligonucleotide
cagcctctgatgcaaatgcataaaga

SEQ ID NO: 1921 - DNA, 30 bp, Artificial Sequence
  Description of Artificial Sequence: Synthetic oligonucleotide
cagcctctgatgcaaatgcataaagaggac

SEQ ID NO: 1922 - DNA, 34 bp, Artificial Sequence
  Description of Artificial Sequence: Synthetic oligonucleotide
cagcctctgatgcaaatgcataaagaggactcag

SEQ ID NO: 1923 - DNA, 38 bp, Artificial Sequence
  Description of Artificial Sequence: Synthetic oligonucleotide
cagcctctgatgcaaatgcataaagaggactcagtatt

SEQ ID NO: 1924 - DNA, 20 bp, Artificial Sequence
  Description of Artificial Sequence: Synthetic oligonucleotide
cctctgatgcaaatgcataa

SEQ ID NO: 1925 - DNA, 24 bp, Artificial Sequence
  Description of Artificial Sequence: Synthetic oligonucleotide
cctctgatgcaaatgcataaagag

SEQ ID NO: 1926 - DNA, 28 bp, Artificial Sequence
  Description of Artificial Sequence: Synthetic oligonucleotide
cctctgatgcaaatgcataaagaggact

SEQ ID NO: 1927 - DNA, 32 bp, Artificial Sequence
  Description of Artificial Sequence: Synthetic oligonucleotide
cctctgatgcaaatgcataaagaggactcagt

SEQ ID NO: 1928 - DNA, 36 bp, Artificial Sequence
  Description of Artificial Sequence: Synthetic oligonucleotide
cctctgatgcaaatgcataaagaggactcagtattg

SEQ ID NO: 1929 - DNA, 40 bp, Artificial Sequence
  Description of Artificial Sequence: Synthetic oligonucleotide
cctctgatgcaaatgcataaagaggactcagtattgattt

SEQ ID NO: 1930 - DNA, 19 bp, Artificial Sequence
  Description of Artificial Sequence: Synthetic oligonucleotide
cctctttatgcatttgcat

SEQ ID NO: 1931 - DNA, 23 bp, Artificial Sequence
  Description of Artificial Sequence: Synthetic oligonucleotide
cctctttatgcatttgcatcaga

SEQ ID NO: 1932 - DNA, 27 bp, Artificial Sequence
  Description of Artificial Sequence: Synthetic oligonucleotide
cctctttatgcatttgcatcagaggct

SEQ ID NO: 1933 - DNA, 31 bp, Artificial Sequence
  Description of Artificial Sequence: Synthetic oligonucleotide
cctctttatgcatttgcatcagaggctgctc

SEQ ID NO: 1934 - DNA, 35 bp, Artificial Sequence
  Description of Artificial Sequence: Synthetic oligonucleotide
cctctttatgcatttgcatcagaggctgctcgtgt

SEQ ID NO: 1935 - DNA, 27 bp, Artificial Sequence
  Description of Artificial Sequence: Synthetic oligonucleotide
cgagcagcctctgatgcaaatgcataa

SEQ ID NO: 1936 - DNA, 31 bp, Artificial Sequence
  Description of Artificial Sequence: Synthetic oligonucleotide
cgagcagcctctgatgcaaatgcataaagag

SEQ ID NO: 1937 - DNA, 35 bp, Artificial Sequence
  Description of Artificial Sequence: Synthetic oligonucleotide
cgagcagcctctgatgcaaatgcataaagaggact

SEQ ID NO: 1938 - DNA, 37 bp, Artificial Sequence
  Description of Artificial Sequence: Synthetic oligonucleotide
cgtacaacacgagcagcctctgatgcaaatgcataaa

SEQ ID NO: 1939 - DNA, 20 bp, Artificial Sequence
  Description of Artificial Sequence: Synthetic oligonucleotide
ctctgatgcaaatgcataaa

SEQ ID NO: 1940 - DNA, 24 bp, Artificial Sequence
  Description of Artificial Sequence: Synthetic oligonucleotide
ctctgatgcaaatgcataaagagg

SEQ ID NO: 1941 - DNA, 28 bp, Artificial Sequence
  Description of Artificial Sequence: Synthetic oligonucleotide
ctctgatgcaaatgcataaagaggactc

SEQ ID NO: 1942 - DNA, 32 bp, Artificial Sequence
  Description of Artificial Sequence: Synthetic oligonucleotide
ctctgatgcaaatgcataaagaggactcagta

SEQ ID NO: 1943 - DNA, 36 bp, Artificial Sequence
  Description of Artificial Sequence: Synthetic oligonucleotide
ctctgatgcaaatgcataaagaggactcagtattga

SEQ ID NO: 1944 - DNA, 40 bp, Artificial Sequence
  Description of Artificial Sequence: Synthetic oligonucleotide
ctctgatgcaaatgcataaagaggactcagtattgatttc

SEQ ID NO: 1945 - DNA, 18 bp, Artificial Sequence
  Description of Artificial Sequence: Synthetic oligonucleotide
ctctttatgcatttgcat

SEQ ID NO: 1946 - DNA, 22 bp, Artificial Sequence
  Description of Artificial Sequence: Synthetic oligonucleotide
ctctttatgcatttgcatcaga

SEQ ID NO: 1947 - DNA, 26 bp, Artificial Sequence
  Description of Artificial Sequence: Synthetic oligonucleotide
ctctttatgcatttgcatcagaggct

SEQ ID NO: 1948 - DNA, 30 bp, Artificial Sequence
  Description of Artificial Sequence: Synthetic oligonucleotide
ctctttatgcatttgcatcagaggctgctc

SEQ ID NO: 1949 - DNA, 34 bp, Artificial Sequence
  Description of Artificial Sequence: Synthetic oligonucleotide
ctctttatgcatttgcatcagaggctgctcgtgt

SEQ ID NO: 1950 - DNA, 38 bp, Artificial Sequence
  Description of Artificial Sequence: Synthetic oligonucleotide
ctctttatgcatttgcatcagaggctgctcgtgttgta

SEQ ID NO: 1951 - DNA, 24 bp, Artificial Sequence
  Description of Artificial Sequence: Synthetic oligonucleotide
ctgagtcctctttatgcatttgca

SEQ ID NO: 1952 - DNA, 28 bp, Artificial Sequence
  Description of Artificial Sequence: Synthetic oligonucleotide
ctgagtcctctttatgcatttgcatcag

SEQ ID NO: 1953 - DNA, 32 bp, Artificial Sequence
  Description of Artificial Sequence: Synthetic oligonucleotide
ctgagtcctctttatgcatttgcatcagaggc

SEQ ID NO: 1954 - DNA, 36 bp, Artificial Sequence
  Description of Artificial Sequence: Synthetic oligonucleotide
ctgagtcctctttatgcatttgcatcagaggctgct

SEQ ID NO: 1955 - DNA, 17 bp, Artificial Sequence
  Description of Artificial Sequence: Synthetic oligonucleotide
ctgatgcaaatgcataa

SEQ ID NO: 1956 - DNA, 21 bp, Artificial Sequence
  Description of Artificial Sequence: Synthetic oligonucleotide
ctgatgcaaatgcataaagag

SEQ ID NO: 1957 - DNA, 25 bp, Artificial Sequence
  Description of Artificial Sequence: Synthetic oligonucleotide
ctgatgcaaatgcataaagaggact

SEQ ID NO: 1958 - DNA, 29 bp, Artificial Sequence
  Description of Artificial Sequence: Synthetic oligonucleotide
ctgatgcaaatgcataaagaggactcagt

SEQ ID NO: 1959 - DNA, 33 bp, Artificial Sequence
  Description of Artificial Sequence: Synthetic oligonucleotide
ctgatgcaaatgcataaagaggactcagtattg

SEQ ID NO: 1960 - DNA, 37 bp, Artificial Sequence
  Description of Artificial Sequence: Synthetic oligonucleotide
ctgatgcaaatgcataaagaggactcagtattgattt

SEQ ID NO: 1961 - DNA, 16 bp, Artificial Sequence
  Description of Artificial Sequence: Synthetic oligonucleotide
ctttatgcatttgcat

SEQ ID NO: 1962 - DNA, 20 bp, Artificial Sequence
  Description of Artificial Sequence: Synthetic oligonucleotide
ctttatgcatttgcatcaga

SEQ ID NO: 1963 - DNA, 24 bp, Artificial Sequence
  Description of Artificial Sequence: Synthetic oligonucleotide
ctttatgcatttgcatcagaggct

SEQ ID NO: 1964 - DNA, 28 bp, Artificial Sequence
  Description of Artificial Sequence: Synthetic oligonucleotide
ctttatgcatttgcatcagaggctgctc

SEQ ID NO: 1965 - DNA, 32 bp, Artificial Sequence
  Description of Artificial Sequence: Synthetic oligonucleotide
ctttatgcatttgcatcagaggctgctcgtgt

SEQ ID NO: 1966 - DNA, 36 bp, Artificial Sequence
  Description of Artificial Sequence: Synthetic oligonucleotide
ctttatgcatttgcatcagaggctgctcgtgttgta

SEQ ID NO: 1967 - DNA, 34 bp, Artificial Sequence
  Description of Artificial Sequence: Synthetic oligonucleotide
tacaacacgagcagcctctgatgcaaatgcataa

SEQ ID NO: 1968 - DNA, 38 bp, Artificial Sequence
  Description of Artificial Sequence: Synthetic oligonucleotide
tacaacacgagcagcctctgatgcaaatgcataaagag

SEQ ID NO: 1969 - DNA, 27 bp, Artificial Sequence
  Description of Artificial Sequence: Synthetic oligonucleotide
tactgagtcctctttatgcatttgcat

SEQ ID NO: 1970 - DNA, 31 bp, Artificial Sequence
  Description of Artificial Sequence: Synthetic oligonucleotide
tactgagtcctctttatgcatttgcatcaga

SEQ ID NO: 1971 - DNA, 35 bp, Artificial Sequence
  Description of Artificial Sequence: Synthetic oligonucleotide
tactgagtcctctttatgcatttgcatcagaggct

SEQ ID NO: 1972 - DNA, 39 bp, Artificial Sequence
  Description of Artificial Sequence: Synthetic oligonucleotide
tactgagtcctctttatgcatttgcatcagaggctgctc

SEQ ID NO: 1973 - DNA, 15 bp, Artificial Sequence
  Description of Artificial Sequence: Synthetic oligonucleotide
tatgcatttgcatca

SEQ ID NO: 1974 - DNA, 19 bp, Artificial Sequence
  Description of Artificial Sequence: Synthetic oligonucleotide
tatgcatttgcatcagagg

SEQ ID NO: 1975 - DNA, 23 bp, Artificial Sequence
  Description of Artificial Sequence: Synthetic oligonucleotide
tatgcatttgcatcagaggctgc

SEQ ID NO: 1976 - DNA, 27 bp, Artificial Sequence
  Description of Artificial Sequence: Synthetic oligonucleotide
tatgcatttgcatcagaggctgctcgt

SEQ ID NO: 1977 - DNA, 31 bp, Artificial Sequence
  Description of Artificial Sequence: Synthetic oligonucleotide
tatgcatttgcatcagaggctgctcgtgttg

SEQ ID NO: 1978 - DNA, 35 bp, Artificial Sequence
  Description of Artificial Sequence: Synthetic oligonucleotide
tatgcatttgcatcagaggctgctcgtgttgtacg

SEQ ID NO: 1979 - DNA, 31 bp, Artificial Sequence
  Description of Artificial Sequence: Synthetic oligonucleotide
tcaatactgagtcctctttatgcatttgcat

SEQ ID NO: 1980 - DNA, 35 bp, Artificial Sequence
  Description of Artificial Sequence: Synthetic oligonucleotide
tcaatactgagtcctctttatgcatttgcatcaga

SEQ ID NO: 1981 - DNA, 39 bp, Artificial Sequence
  Description of Artificial Sequence: Synthetic oligonucleotide
tcaatactgagtcctctttatgcatttgcatcagaggct

SEQ ID NO: 1982 - DNA, 19 bp, Artificial Sequence
  Description of Artificial Sequence: Synthetic oligonucleotide
tcctctttatgcatttgca

SEQ ID NO: 1983 - DNA, 23 bp, Artificial Sequence
  Description of Artificial Sequence: Synthetic oligonucleotide
tcctctttatgcatttgcatcag

SEQ ID NO: 1984 - DNA, 27 bp, Artificial Sequence
  Description of Artificial Sequence: Synthetic oligonucleotide
tcctctttatgcatttgcatcagaggc

SEQ ID NO: 1985 - DNA, 31 bp, Artificial Sequence
  Description of Artificial Sequence: Synthetic oligonucleotide
tcctctttatgcatttgcatcagaggctgct

SEQ ID NO: 1986 - DNA, 35 bp, Artificial Sequence
  Description of Artificial Sequence: Synthetic oligonucleotide
tcctctttatgcatttgcatcagaggctgctcgtg

SEQ ID NO: 1987 - DNA, 36 bp, Artificial Sequence
  Description of Artificial Sequence: Synthetic oligonucleotide
tcgtacaacacgagcagcctctgatgcaaatgcata

SEQ ID NO: 1988 - DNA, 20 bp, Artificial Sequence
  Description of Artificial Sequence: Synthetic oligonucleotide
tctgatgcaaatgcataaag

SEQ ID NO: 1989 - DNA, 24 bp, Artificial Sequence
  Description of Artificial Sequence: Synthetic oligonucleotide
tctgatgcaaatgcataaagagga

SEQ ID NO: 1990 - DNA, 28 bp, Artificial Sequence
  Description of Artificial Sequence: Synthetic oligonucleotide
tctgatgcaaatgcataaagaggactca

SEQ ID NO: 1991 - DNA, 32 bp, Artificial Sequence
  Description of Artificial Sequence: Synthetic oligonucleotide
tctgatgcaaatgcataaagaggactcagtat

SEQ ID NO: 1992 - DNA, 36 bp, Artificial Sequence
  Description of Artificial Sequence: Synthetic oligonucleotide
tctgatgcaaatgcataaagaggactcagtattgat

SEQ ID NO: 1993 - DNA, 14 bp, Artificial Sequence
  Description of Artificial Sequence: Synthetic oligonucleotide
tctttatgcatttg

SEQ ID NO: 1994 - DNA, 18 bp, Artificial Sequence
  Description of Artificial Sequence: Synthetic oligonucleotide
tctttatgcatttgcatc

SEQ ID NO: 1995 - DNA, 22 bp, Artificial Sequence
  Description of Artificial Sequence: Synthetic oligonucleotide
tctttatgcatttgcatcagag

SEQ ID NO: 1996 - DNA, 26 bp, Artificial Sequence
  Description of Artificial Sequence: Synthetic oligonucleotide
tctttatgcatttgcatcagaggctg

SEQ ID NO: 1997 - DNA, 30 bp, Artificial Sequence
  Description of Artificial Sequence: Synthetic oligonucleotide
tctttatgcatttgcatcagaggctgctcg

SEQ ID NO: 1998 - DNA, 34 bp, Artificial Sequence
  Description of Artificial Sequence: Synthetic oligonucleotide
tctttatgcatttgcatcagaggctgctcgtgtt

SEQ ID NO: 1999 - DNA, 38 bp, Artificial Sequence
  Description of Artificial Sequence: Synthetic oligonucleotide
tctttatgcatttgcatcagaggctgctcgtgttgtac

SEQ ID NO: 2000 - DNA, 21 bp, Artificial Sequence
  Description of Artificial Sequence: Synthetic oligonucleotide
tgagtcctctttatgcatttg

SEQ ID NO: 2001 - DNA, 25 bp, Artificial Sequence
  Description of Artificial Sequence: Synthetic oligonucleotide
tgagtcctctttatgcatttgcatc

SEQ ID NO: 2002 - DNA, 29 bp, Artificial Sequence
  Description of Artificial Sequence: Synthetic oligonucleotide
tgagtcctctttatgcatttgcatcagag

SEQ ID NO: 2003 - DNA, 33 bp, Artificial Sequence
  Description of Artificial Sequence: Synthetic oligonucleotide
tgagtcctctttatgcatttgcatcagaggctg

SEQ ID NO: 2004 - DNA, 37 bp, Artificial Sequence
  Description of Artificial Sequence: Synthetic oligonucleotide
tgagtcctctttatgcatttgcatcagaggctgctcg

SEQ ID NO: 2005 - DNA, 18 bp, Artificial Sequence
  Description of Artificial Sequence: Synthetic oligonucleotide
tgatgcaaatgcataaag

SEQ ID NO: 2006 - DNA, 22 bp, Artificial Sequence
  Description of Artificial Sequence: Synthetic oligonucleotide
tgatgcaaatgcataaagagga

SEQ ID NO: 2007 - DNA, 26 bp, Artificial Sequence
  Description of Artificial Sequence: Synthetic oligonucleotide
tgatgcaaatgcataaagaggactca

SEQ ID NO: 2008 - DNA, 30 bp, Artificial Sequence
  Description of Artificial Sequence: Synthetic oligonucleotide
tgatgcaaatgcataaagaggactcagtat

SEQ ID NO: 2009 - DNA, 34 bp, Artificial Sequence
  Description of Artificial Sequence: Synthetic oligonucleotide
tgatgcaaatgcataaagaggactcagtattgat

SEQ ID NO: 2010 - DNA, 13 bp, Artificial Sequence
  Description of Artificial Sequence: Synthetic oligonucleotide
tgcaaatgcataa

SEQ ID NO: 2011 - DNA, 17 bp, Artificial Sequence
  Description of Artificial Sequence: Synthetic oligonucleotide
tgcaaatgcataaagag

SEQ ID NO: 2012 - DNA, 21 bp, Artificial Sequence
  Description of Artificial Sequence: Synthetic oligonucleotide
tgcaaatgcataaagaggact

SEQ ID NO: 2013 - DNA, 25 bp, Artificial Sequence
  Description of Artificial Sequence: Synthetic oligonucleotide
tgcaaatgcataaagaggactcagt

SEQ ID NO: 2014 - DNA, 29 bp, Artificial Sequence
  Description of Artificial Sequence: Synthetic oligonucleotide
tgcaaatgcataaagaggactcagtattg

SEQ ID NO: 2015 - DNA, 33 bp, Artificial Sequence
  Description of Artificial Sequence: Synthetic oligonucleotide
tgcaaatgcataaagaggactcagtattgattt

SEQ ID NO: 2016 - DNA, 15 bp, Artificial Sequence
  Description of Artificial Sequence: Synthetic oligonucleotide
ttatgcatttgcatc

SEQ ID NO: 2017 - DNA, 19 bp, Artificial Sequence
  Description of Artificial Sequence: Synthetic oligonucleotide
ttatgcatttgcatcagag

SEQ ID NO: 2018 - DNA, 23 bp, Artificial Sequence
  Description of Artificial Sequence: Synthetic oligonucleotide
ttatgcatttgcatcagaggctg

SEQ ID NO: 2019 - DNA, 27 bp, Artificial Sequence
  Description of Artificial Sequence: Synthetic oligonucleotide
ttatgcatttgcatcagaggctgctcg

SEQ ID NO: 2020 - DNA, 31 bp, Artificial Sequence
  Description of Artificial Sequence: Synthetic oligonucleotide
ttatgcatttgcatcagaggctgctcgtgtt

SEQ ID NO: 2021 - DNA, 35 bp, Artificial Sequence
  Description of Artificial Sequence: Synthetic oligonucleotide
ttatgcatttgcatcagaggctgctcgtgttgtac

SEQ ID NO: 2022 - DNA, 15 bp, Artificial Sequence
  Description of Artificial Sequence: Synthetic oligonucleotide
tttatgcatttgcat

SEQ ID NO: 2023 - DNA, 19 bp, Artificial Sequence
  Description of Artificial Sequence: Synthetic oligonucleotide
tttatgcatttgcatcaga

SEQ ID NO: 2024 - DNA, 23 bp, Artificial Sequence
  Description of Artificial Sequence: Synthetic oligonucleotide
tttatgcatttgcatcagaggct

SEQ ID NO: 2025 - DNA, 27 bp, Artificial Sequence
  Description of Artificial Sequence: Synthetic oligonucleotide
tttatgcatttgcatcagaggctgctc

SEQ ID NO: 2026 - DNA, 31 bp, Artificial Sequence
  Description of Artificial Sequence: Synthetic oligonucleotide
tttatgcatttgcatcagaggctgctcgtgt

SEQ ID NO: 2027 - DNA, 35 bp, Artificial Sequence
  Description of Artificial Sequence: Synthetic oligonucleotide
tttatgcatttgcatcagaggctgctcgtgttgta

SEQ ID NO: 2028 - DNA, 40 bp, Artificial Sequence
  Description of Artificial Sequence: Synthetic oligonucleotide
aaacctcttagtaccattggtcccagagacatgtatagca

SEQ ID NO: 2029 - DNA, 28 bp, Artificial Sequence
  Description of Artificial Sequence: Synthetic oligonucleotide
aatgttacttggttccatgctatacatg

SEQ ID NO: 2030 - DNA, 32 bp, Artificial Sequence
  Description of Artificial Sequence: Synthetic oligonucleotide
aatgttacttggttccatgctatacatgtctc

SEQ ID NO: 2031 - DNA, 36 bp, Artificial Sequence
  Description of Artificial Sequence: Synthetic oligonucleotide
aatgttacttggttccatgctatacatgtctctggg

SEQ ID NO: 2032 - DNA, 40 bp, Artificial Sequence
  Description of Artificial Sequence: Synthetic oligonucleotide
aatgttacttggttccatgctatacatgtctctgggacca

SEQ ID NO: 2033 - DNA, 17 bp, Artificial Sequence
  Description of Artificial Sequence: Synthetic oligonucleotide
acatgtatagcatggaa

SEQ ID NO: 2034 - DNA, 21 bp, Artificial Sequence
  Description of Artificial Sequence: Synthetic oligonucleotide
acatgtatagcatggaaccaa

SEQ ID NO: 2035 - DNA, 25 bp, Artificial Sequence
  Description of Artificial Sequence: Synthetic oligonucleotide
acatgtatagcatggaaccaagtaa

SEQ ID NO: 2036 - DNA, 29 bp, Artificial Sequence
  Description of Artificial Sequence: Synthetic oligonucleotide
acatgtatagcatggaaccaagtaacatt

SEQ ID NO: 2037 - DNA, 33 bp, Artificial Sequence
  Description of Artificial Sequence: Synthetic oligonucleotide
acatgtatagcatggaaccaagtaacattggaa

SEQ ID NO: 2038 - DNA, 37 bp, Artificial Sequence
  Description of Artificial Sequence: Synthetic oligonucleotide
acatgtatagcatggaaccaagtaacattggaaaaga

SEQ ID NO: 2039 - DNA, 27 bp, Artificial Sequence
  Description of Artificial Sequence: Synthetic oligonucleotide
accattggtcccagagacatgtatagc

SEQ ID NO: 2040 - DNA, 31 bp, Artificial Sequence
  Description of Artificial Sequence: Synthetic oligonucleotide
accattggtcccagagacatgtatagcatgg

SEQ ID NO: 2041 - DNA, 35 bp, Artificial Sequence
  Description of Artificial Sequence: Synthetic oligonucleotide
accattggtcccagagacatgtatagcatggaacc

SEQ ID NO: 2042 - DNA, 37 bp, Artificial Sequence
  Description of Artificial Sequence: Synthetic oligonucleotide
acctcttagtaccattggtcccagagacatgtatagc

SEQ ID NO: 2043 - DNA, 22 bp, Artificial Sequence
  Description of Artificial Sequence: Synthetic oligonucleotide
acttggttccatgctatacatg

SEQ ID NO: 2044 - DNA, 26 bp, Artificial Sequence
  Description of Artificial Sequence: Synthetic oligonucleotide
acttggttccatgctatacatgtctc

SEQ ID NO: 2045 - DNA, 30 bp, Artificial Sequence
  Description of Artificial Sequence: Synthetic oligonucleotide
acttggttccatgctatacatgtctctggg

SEQ ID NO: 2046 - DNA, 34 bp, Artificial Sequence
  Description of Artificial Sequence: Synthetic oligonucleotide
acttggttccatgctatacatgtctctgggacca

SEQ ID NO: 2047 - DNA, 38 bp, Artificial Sequence
  Description of Artificial Sequence: Synthetic oligonucleotide
acttggttccatgctatacatgtctctgggaccaatgg

SEQ ID NO: 2048 - DNA, 15 bp, Artificial Sequence
  Description of Artificial Sequence: Synthetic oligonucleotide
agacatgtatagcat

SEQ ID NO: 2049 - DNA, 19 bp, Artificial Sequence
  Description of Artificial Sequence: Synthetic oligonucleotide
agacatgtatagcatggaa

SEQ ID NO: 2050 - DNA, 23 bp, Artificial Sequence
  Description of Artificial Sequence: Synthetic oligonucleotide
agacatgtatagcatggaaccaa

SEQ ID NO: 2051 - DNA, 27 bp, Artificial Sequence
  Description of Artificial Sequence: Synthetic oligonucleotide
agacatgtatagcatggaaccaagtaa

SEQ ID NO: 2052 - DNA, 31 bp, Artificial Sequence
  Description of Artificial Sequence: Synthetic oligonucleotide
agacatgtatagcatggaaccaagtaacatt

SEQ ID NO: 2053 - DNA, 35 bp, Artificial Sequence
  Description of Artificial Sequence: Synthetic oligonucleotide
agacatgtatagcatggaaccaagtaacattggaa

SEQ ID NO: 2054 - DNA, 39 bp, Artificial Sequence
  Description of Artificial Sequence: Synthetic oligonucleotide
agacatgtatagcatggaaccaagtaacattggaaaaga

SEQ ID NO: 2055 - DNA, 17 bp, Artificial Sequence
  Description of Artificial Sequence: Synthetic oligonucleotide
agagacatgtatagcat

SEQ ID NO: 2056 - DNA, 21 bp, Artificial Sequence
  Description of Artificial Sequence: Synthetic oligonucleotide
agagacatgtatagcatggaa

SEQ ID NO: 2057 - DNA, 25 bp, Artificial Sequence
  Description of Artificial Sequence: Synthetic oligonucleotide
agagacatgtatagcatggaaccaa

SEQ ID NO: 2058 - DNA, 29 bp, Artificial Sequence
  Description of Artificial Sequence: Synthetic oligonucleotide
agagacatgtatagcatggaaccaagtaa

SEQ ID NO: 2059 - DNA, 33 bp, Artificial Sequence
  Description of Artificial Sequence: Synthetic oligonucleotide
agagacatgtatagcatggaaccaagtaacatt

SEQ ID NO: 2060 - DNA, 37 bp, Artificial Sequence
  Description of Artificial Sequence: Synthetic oligonucleotide
agagacatgtatagcatggaaccaagtaacattggaa

SEQ ID NO: 2061 - DNA, 30 bp, Artificial Sequence
  Description of Artificial Sequence: Synthetic oligonucleotide
agtaccattggtcccagagacatgtatagc

SEQ ID NO: 2062 - DNA, 34 bp, Artificial Sequence
  Description of Artificial Sequence: Synthetic oligonucleotide
agtaccattggtcccagagacatgtatagcatgg

SEQ ID NO: 2063 - DNA, 38 bp, Artificial Sequence
  Description of Artificial Sequence: Synthetic oligonucleotide
agtaccattggtcccagagacatgtatagcatggaacc

SEQ ID NO: 2064 - DNA, 17 bp, Artificial Sequence
  Description of Artificial Sequence: Synthetic oligonucleotide
atgctatacatgtctct

SEQ ID NO: 2065 - DNA, 21 bp, Artificial Sequence
  Description of Artificial Sequence: Synthetic oligonucleotide
atgctatacatgtctctggga

SEQ ID NO: 2066 - DNA, 25 bp, Artificial Sequence
  Description of Artificial Sequence: Synthetic oligonucleotide
atgctatacatgtctctgggaccaa

SEQ ID NO: 2067 - DNA, 29 bp, Artificial Sequence
  Description of Artificial Sequence: Synthetic oligonucleotide
atgctatacatgtctctgggaccaatggt

SEQ ID NO: 2068 - DNA, 33 bp, Artificial Sequence
  Description of Artificial Sequence: Synthetic oligonucleotide
atgctatacatgtctctgggaccaatggtacta

SEQ ID NO: 2069 - DNA, 37 bp, Artificial Sequence
  Description of Artificial Sequence: Synthetic oligonucleotide
atgctatacatgtctctgggaccaatggtactaagag

SEQ ID NO: 2070 - DNA, 27 bp, Artificial Sequence
  Description of Artificial Sequence: Synthetic oligonucleotide
atgttacttggttccatgctatacatg

SEQ ID NO: 2071 - DNA, 31 bp, Artificial Sequence
  Description of Artificial Sequence: Synthetic oligonucleotide
atgttacttggttccatgctatacatgtctc

SEQ ID NO: 2072 - DNA, 35 bp, Artificial Sequence
  Description of Artificial Sequence: Synthetic oligonucleotide
atgttacttggttccatgctatacatgtctctggg

SEQ ID NO: 2073 - DNA, 39 bp, Artificial Sequence
  Description of Artificial Sequence: Synthetic oligonucleotide
atgttacttggttccatgctatacatgtctctgggacca

SEQ ID NO: 2074 - DNA, 26 bp, Artificial Sequence
  Description of Artificial Sequence: Synthetic oligonucleotide
attggtcccagagacatgtatagcat

SEQ ID NO: 2075 - DNA, 30 bp, Artificial Sequence
  Description of Artificial Sequence: Synthetic oligonucleotide
attggtcccagagacatgtatagcatggaa

SEQ ID NO: 2076 - DNA, 34 bp, Artificial Sequence
  Description of Artificial Sequence: Synthetic oligonucleotide
attggtcccagagacatgtatagcatggaaccaa

SEQ ID NO: 2077 - DNA, 38 bp, Artificial Sequence
  Description of Artificial Sequence: Synthetic oligonucleotide
attggtcccagagacatgtatagcatggaaccaagtaa

SEQ ID NO: 2078 - DNA, 29 bp, Artificial Sequence
  Description of Artificial Sequence: Synthetic oligonucleotide
caatgttacttggttccatgctatacatg

SEQ ID NO: 2079 - DNA, 33 bp, Artificial Sequence
  Description of Artificial Sequence: Synthetic oligonucleotide
caatgttacttggttccatgctatacatgtctc

SEQ ID NO: 2080 - DNA, 37 bp, Artificial Sequence
  Description of Artificial Sequence: Synthetic oligonucleotide
caatgttacttggttccatgctatacatgtctctggg

SEQ ID NO: 2081 - DNA, 16 bp, Artificial Sequence
  Description of Artificial Sequence: Synthetic oligonucleotide
cagagacatgtatagc

SEQ ID NO: 2082 - DNA, 20 bp, Artificial Sequence
  Description of Artificial Sequence: Synthetic oligonucleotide
cagagacatgtatagcatgg

SEQ ID NO: 2083 - DNA, 24 bp, Artificial Sequence
  Description of Artificial Sequence: Synthetic oligonucleotide
cagagacatgtatagcatggaacc

SEQ ID NO: 2084 - DNA, 28 bp, Artificial Sequence
  Description of Artificial Sequence: Synthetic oligonucleotide
cagagacatgtatagcatggaaccaagt

SEQ ID NO: 2085 - DNA, 32 bp, Artificial Sequence
  Description of Artificial Sequence: Synthetic oligonucleotide
cagagacatgtatagcatggaaccaagtaaca

SEQ ID NO: 2086 - DNA, 36 bp, Artificial Sequence
  Description of Artificial Sequence: Synthetic oligonucleotide
cagagacatgtatagcatggaaccaagtaacattgg

SEQ ID NO: 2087 - DNA, 40 bp, Artificial Sequence
  Description of Artificial Sequence: Synthetic oligonucleotide
cagagacatgtatagcatggaaccaagtaacattggaaaa

SEQ ID NO: 2088 - DNA, 17 bp, Artificial Sequence
  Description of Artificial Sequence: Synthetic oligonucleotide
catgctatacatgtctc

SEQ ID NO: 2089 - DNA, 21 bp, Artificial Sequence
  Description of Artificial Sequence: Synthetic oligonucleotide
catgctatacatgtctctggg

SEQ ID NO: 2090 - DNA, 25 bp, Artificial Sequence
  Description of Artificial Sequence: Synthetic oligonucleotide
catgctatacatgtctctgggacca

SEQ ID NO: 2091 - DNA, 29 bp, Artificial Sequence
  Description of Artificial Sequence: Synthetic oligonucleotide
catgctatacatgtctctgggaccaatgg

SEQ ID NO: 2092 - DNA, 33 bp, Artificial Sequence
  Description of Artificial Sequence: Synthetic oligonucleotide
catgctatacatgtctctgggaccaatggtact

SEQ ID NO: 2093 - DNA, 37 bp, Artificial Sequence
  Description of Artificial Sequence: Synthetic oligonucleotide
catgctatacatgtctctgggaccaatggtactaaga

SEQ ID NO: 2094 - DNA, 14 bp, Artificial Sequence
  Description of Artificial Sequence: Synthetic oligonucleotide
catgtatagcatgg

SEQ ID NO: 2095 - DNA, 18 bp, Artificial Sequence
  Description of Artificial Sequence: Synthetic oligonucleotide
catgtatagcatggaacc

SEQ ID NO: 2096 - DNA, 22 bp, Artificial Sequence
  Description of Artificial Sequence: Synthetic oligonucleotide
catgtatagcatggaaccaagt

SEQ ID NO: 2097 - DNA, 26 bp, Artificial Sequence
  Description of Artificial Sequence: Synthetic oligonucleotide
catgtatagcatggaaccaagtaaca

SEQ ID NO: 2098 - DNA, 30 bp, Artificial Sequence
  Description of Artificial Sequence: Synthetic oligonucleotide
catgtatagcatggaaccaagtaacattgg

SEQ ID NO: 2099 - DNA, 34 bp, Artificial Sequence
  Description of Artificial Sequence: Synthetic oligonucleotide
catgtatagcatggaaccaagtaacattggaaaa

SEQ ID NO: 2100 - DNA, 38 bp, Artificial Sequence
  Description of Artificial Sequence: Synthetic oligonucleotide
catgtatagcatggaaccaagtaacattggaaaagaaa

SEQ ID NO: 2101 - DNA, 26 bp, Artificial Sequence
  Description of Artificial Sequence: Synthetic oligonucleotide
cattggtcccagagacatgtatagca

SEQ ID NO: 2102 - DNA, 30 bp, Artificial Sequence
  Description of Artificial Sequence: Synthetic oligonucleotide
cattggtcccagagacatgtatagcatgga

SEQ ID NO: 2103 - DNA, 34 bp, Artificial Sequence
  Description of Artificial Sequence: Synthetic oligonucleotide
cattggtcccagagacatgtatagcatggaacca

SEQ ID NO: 2104 - DNA, 38 bp, Artificial Sequence
  Description of Artificial Sequence: Synthetic oligonucleotide
cattggtcccagagacatgtatagcatggaaccaagta

SEQ ID NO: 2105 - DNA, 31 bp, Artificial Sequence
  Description of Artificial Sequence: Synthetic oligonucleotide
ccaatgttacttggttccatgctatacatgt

SEQ ID NO: 2106 - DNA, 35 bp, Artificial Sequence
  Description of Artificial Sequence: Synthetic oligonucleotide
ccaatgttacttggttccatgctatacatgtctct

SEQ ID NO: 2107 - DNA, 39 bp, Artificial Sequence
  Description of Artificial Sequence: Synthetic oligonucleotide
ccaatgttacttggttccatgctatacatgtctctggga

SEQ ID NO: 2108 - DNA, 19 bp, Artificial Sequence
  Description of Artificial Sequence: Synthetic oligonucleotide
ccagagacatgtatagcat

SEQ ID NO: 2109 - DNA, 23 bp, Artificial Sequence
  Description of Artificial Sequence: Synthetic oligonucleotide
ccagagacatgtatagcatggaa

SEQ ID NO: 2110 - DNA, 27 bp, Artificial Sequence
  Description of Artificial Sequence: Synthetic oligonucleotide
ccagagacatgtatagcatggaaccaa

SEQ ID NO: 2111 - DNA, 31 bp, Artificial Sequence
  Description of Artificial Sequence: Synthetic oligonucleotide
ccagagacatgtatagcatggaaccaagtaa

SEQ ID NO: 2112 - DNA, 35 bp, Artificial Sequence
  Description of Artificial Sequence: Synthetic oligonucleotide
ccagagacatgtatagcatggaaccaagtaacatt

SEQ ID NO: 2113 - DNA, 39 bp, Artificial Sequence
  Description of Artificial Sequence: Synthetic oligonucleotide
ccagagacatgtatagcatggaaccaagtaacattggaa

SEQ ID NO: 2114 - DNA, 16 bp, Artificial Sequence
  Description of Artificial Sequence: Synthetic oligonucleotide
ccatgctatacatgtc

SEQ ID NO: 2115 - DNA, 20 bp, Artificial Sequence
  Description of Artificial Sequence: Synthetic oligonucleotide
ccatgctatacatgtctctg

SEQ ID NO: 2116 - DNA, 24 bp, Artificial Sequence
  Description of Artificial Sequence: Synthetic oligonucleotide
ccatgctatacatgtctctgggac

SEQ ID NO: 2117 - DNA, 28 bp, Artificial Sequence
  Description of Artificial Sequence: Synthetic oligonucleotide
ccatgctatacatgtctctgggaccaat

SEQ ID NO: 2118 - DNA, 32 bp, Artificial Sequence
  Description of Artificial Sequence: Synthetic oligonucleotide
ccatgctatacatgtctctgggaccaatggta

SEQ ID NO: 2119 - DNA, 36 bp, Artificial Sequence
  Description of Artificial Sequence: Synthetic oligonucleotide
ccatgctatacatgtctctgggaccaatggtactaa

SEQ ID NO: 2120 - DNA, 40 bp, Artificial Sequence
  Description of Artificial Sequence: Synthetic oligonucleotide
ccatgctatacatgtctctgggaccaatggtactaagagg

SEQ ID NO: 2121 - DNA, 29 bp, Artificial Sequence
  Description of Artificial Sequence: Synthetic oligonucleotide
ccattggtcccagagacatgtatagcatg

SEQ ID NO: 2122 - DNA, 33 bp, Artificial Sequence
  Description of Artificial Sequence: Synthetic oligonucleotide
ccattggtcccagagacatgtatagcatggaac

SEQ ID NO: 2123 - DNA, 37 bp, Artificial Sequence
  Description of Artificial Sequence: Synthetic oligonucleotide
ccattggtcccagagacatgtatagcatggaaccaag

SEQ ID NO: 2124 - DNA, 18 bp, Artificial Sequence
  Description of Artificial Sequence: Synthetic oligonucleotide
cccagagacatgtatagc

SEQ ID NO: 2125 - DNA, 22 bp, Artificial Sequence
  Description of Artificial Sequence: Synthetic oligonucleotide
cccagagacatgtatagcatgg

SEQ ID NO: 2126 - DNA, 26 bp, Artificial Sequence
  Description of Artificial Sequence: Synthetic oligonucleotide
cccagagacatgtatagcatggaacc

SEQ ID NO: 2127 - DNA, 30 bp, Artificial Sequence
  Description of Artificial Sequence: Synthetic oligonucleotide
cccagagacatgtatagcatggaaccaagt

SEQ ID NO: 2128 - DNA, 34 bp, Artificial Sequence
  Description of Artificial Sequence: Synthetic oligonucleotide
cccagagacatgtatagcatggaaccaagtaaca

SEQ ID NO: 2129 - DNA, 38 bp, Artificial Sequence
  Description of Artificial Sequence: Synthetic oligonucleotide
cccagagacatgtatagcatggaaccaagtaacattgg

SEQ ID NO: 2130 - DNA, 37 bp, Artificial Sequence
  Description of Artificial Sequence: Synthetic oligonucleotide
cctcttagtaccattggtcccagagacatgtatagca

SEQ ID NO: 2131 - DNA, 40 bp, Artificial Sequence
  Description of Artificial Sequence: Synthetic oligonucleotide
cctttcttttccaatgttacttggttccatgctatacatg

SEQ ID NO: 2132 - DNA, 38 bp, Artificial Sequence
  Description of Artificial Sequence: Synthetic oligonucleotide
ctcttagtaccattggtcccagagacatgtatagcatg

SEQ ID NO: 2133 - DNA, 34 bp, Artificial Sequence
  Description of Artificial Sequence: Synthetic oligonucleotide
cttagtaccattggtcccagagacatgtatagca

SEQ ID NO: 2134 - DNA, 38 bp, Artificial Sequence
  Description of Artificial Sequence: Synthetic oligonucleotide
cttagtaccattggtcccagagacatgtatagcatgga

SEQ ID NO: 2135 - DNA, 22 bp, Artificial Sequence
  Description of Artificial Sequence: Synthetic oligonucleotide
cttggttccatgctatacatgt

SEQ ID NO: 2136 - DNA, 26 bp, Artificial Sequence
  Description of Artificial Sequence: Synthetic oligonucleotide
cttggttccatgctatacatgtctct

SEQ ID NO: 2137 - DNA, 30 bp, Artificial Sequence
  Description of Artificial Sequence: Synthetic oligonucleotide
cttggttccatgctatacatgtctctggga

SEQ ID NO: 2138 - DNA, 34 bp, Artificial Sequence
  Description of Artificial Sequence: Synthetic oligonucleotide
cttggttccatgctatacatgtctctgggaccaa

SEQ ID NO: 2139 - DNA, 38 bp, Artificial Sequence
  Description of Artificial Sequence: Synthetic oligonucleotide
cttggttccatgctatacatgtctctgggaccaatggt

SEQ ID NO: 2140 - DNA, 40 bp, Artificial Sequence
  Description of Artificial Sequence: Synthetic oligonucleotide
ctttcttttccaatgttacttggttccatgctatacatgt

SEQ ID NO: 2141 - DNA, 38 bp, Artificial Sequence
  Description of Artificial Sequence: Synthetic oligonucleotide
cttttccaatgttacttggttccatgctatacatgtct

SEQ ID NO: 2142 - DNA, 29 bp, Artificial Sequence
  Description of Artificial Sequence: Synthetic oligonucleotide
taccattggtcccagagacatgtatagca

SEQ ID NO: 2143 - DNA, 33 bp, Artificial Sequence
  Description of Artificial Sequence: Synthetic oligonucleotide
taccattggtcccagagacatgtatagcatgga

SEQ ID NO: 2144 - DNA, 37 bp, Artificial Sequence
  Description of Artificial Sequence: Synthetic oligonucleotide
taccattggtcccagagacatgtatagcatggaacca

SEQ ID NO: 2145 - DNA, 23 bp, Artificial Sequence
  Description of Artificial Sequence: Synthetic oligonucleotide
tacttggttccatgctatacatg

SEQ ID NO: 2146 - DNA, 27 bp, Artificial Sequence
  Description of Artificial Sequence: Synthetic oligonucleotide
tacttggttccatgctatacatgtctc

SEQ ID NO: 2147 - DNA, 31 bp, Artificial Sequence
  Description of Artificial Sequence: Synthetic oligonucleotide
tacttggttccatgctatacatgtctctggg

SEQ ID NO: 2148 - DNA, 35 bp, Artificial Sequence
  Description of Artificial Sequence: Synthetic oligonucleotide
tacttggttccatgctatacatgtctctgggacca

SEQ ID NO: 2149 - DNA, 39 bp, Artificial Sequence
  Description of Artificial Sequence: Synthetic oligonucleotide
tacttggttccatgctatacatgtctctgggaccaatgg

SEQ ID NO: 2150 - DNA, 33 bp, Artificial Sequence
  Description of Artificial Sequence: Synthetic oligonucleotide
tagtaccattggtcccagagacatgtatagcat

SEQ ID NO: 2151 - DNA, 37 bp, Artificial Sequence
  Description of Artificial Sequence: Synthetic oligonucleotide
tagtaccattggtcccagagacatgtatagcatggaa

SEQ ID NO: 2152 - DNA, 31 bp, Artificial Sequence
  Description of Artificial Sequence: Synthetic oligonucleotide
tccaatgttacttggttccatgctatacatg

SEQ ID NO: 2153 - DNA, 35 bp, Artificial Sequence
  Description of Artificial Sequence: Synthetic oligonucleotide
tccaatgttacttggttccatgctatacatgtctc

SEQ ID NO: 2154 - DNA, 39 bp, Artificial Sequence
  Description of Artificial Sequence: Synthetic oligonucleotide
tccaatgttacttggttccatgctatacatgtctctggg

SEQ ID NO: 2155 - DNA, 17 bp, Artificial Sequence
  Description of Artificial Sequence: Synthetic oligonucleotide
tccatgctatacatgtc

SEQ ID NO: 2156 - DNA, 21 bp, Artificial Sequence
  Description of Artificial Sequence: Synthetic oligonucleotide
tccatgctatacatgtctctg

SEQ ID NO: 2157 - DNA, 25 bp, Artificial Sequence
  Description of Artificial Sequence: Synthetic oligonucleotide
tccatgctatacatgtctctgggac

SEQ ID NO: 2158 - DNA, 29 bp, Artificial Sequence
  Description of Artificial Sequence: Synthetic oligonucleotide
tccatgctatacatgtctctgggaccaat

SEQ ID NO: 2159 - DNA, 33 bp, Artificial Sequence
  Description of Artificial Sequence: Synthetic oligonucleotide
tccatgctatacatgtctctgggaccaatggta

SEQ ID NO: 2160 - DNA, 37 bp, Artificial Sequence
  Description of Artificial Sequence: Synthetic oligonucleotide
tccatgctatacatgtctctgggaccaatggtactaa

SEQ ID NO: 2161 - DNA, 19 bp, Artificial Sequence
  Description of Artificial Sequence: Synthetic oligonucleotide
tcccagagacatgtatagc

SEQ ID NO: 2162 - DNA, 23 bp, Artificial Sequence
  Description of Artificial Sequence: Synthetic oligonucleotide
tcccagagacatgtatagcatgg

SEQ ID NO: 2163 - DNA, 27 bp, Artificial Sequence
  Description of Artificial Sequence: Synthetic oligonucleotide
tcccagagacatgtatagcatggaacc

SEQ ID NO: 2164 - DNA, 31 bp, Artificial Sequence
  Description of Artificial Sequence: Synthetic oligonucleotide
tcccagagacatgtatagcatggaaccaagt

SEQ ID NO: 2165 - DNA, 35 bp, Artificial Sequence
  Description of Artificial Sequence: Synthetic oligonucleotide
tcccagagacatgtatagcatggaaccaagtaaca

SEQ ID NO: 2166 - DNA, 39 bp, Artificial Sequence
  Description of Artificial Sequence: Synthetic oligonucleotide
tcccagagacatgtatagcatggaaccaagtaacattgg

SEQ ID NO: 2167 - DNA, 36 bp, Artificial Sequence
  Description of Artificial Sequence: Synthetic oligonucleotide
tcttagtaccattggtcccagagacatgtatagcat

SEQ ID NO: 2168 - DNA, 40 bp, Artificial Sequence
  Description of Artificial Sequence: Synthetic oligonucleotide
tcttagtaccattggtcccagagacatgtatagcatggaa

SEQ ID NO: 2169 - DNA, 39 bp, Artificial Sequence
  Description of Artificial Sequence: Synthetic oligonucleotide
tcttttccaatgttacttggttccatgctatacatgtct

SEQ ID NO: 2170 - DNA, 15 bp, Artificial Sequence
  Description of Artificial Sequence: Synthetic oligonucleotide
tgctatacatgtctc

SEQ ID NO: 2171 - DNA, 19 bp, Artificial Sequence
  Description of Artificial Sequence: Synthetic oligonucleotide
tgctatacatgtctctggg

SEQ ID NO: 2172 - DNA, 23 bp, Artificial Sequence
  Description of Artificial Sequence: Synthetic oligonucleotide
tgctatacatgtctctgggacca

SEQ ID NO: 2173 - DNA, 27 bp, Artificial Sequence
  Description of Artificial Sequence: Synthetic oligonucleotide
tgctatacatgtctctgggaccaatgg

SEQ ID NO: 2174 - DNA, 31 bp, Artificial Sequence
  Description of Artificial Sequence: Synthetic oligonucleotide
tgctatacatgtctctgggaccaatggtact

SEQ ID NO: 2175 - DNA, 35 bp, Artificial Sequence
  Description of Artificial Sequence: Synthetic oligonucleotide
tgctatacatgtctctgggaccaatggtactaaga

SEQ ID NO: 2176 - DNA, 39 bp, Artificial Sequence
  Description of Artificial Sequence: Synthetic oligonucleotide
tgctatacatgtctctgggaccaatggtactaagaggtt

SEQ ID NO: 2177 - DNA, 24 bp, Artificial Sequence
  Description of Artificial Sequence: Synthetic oligonucleotide
tggtcccagagacatgtatagcat

SEQ ID NO: 2178 - DNA, 28 bp, Artificial Sequence
  Description of Artificial Sequence: Synthetic oligonucleotide
tggtcccagagacatgtatagcatggaa

SEQ ID NO: 2179 - DNA, 32 bp, Artificial Sequence
  Description of Artificial Sequence: Synthetic oligonucleotide
tggtcccagagacatgtatagcatggaaccaa

SEQ ID NO: 2180 - DNA, 36 bp, Artificial Sequence
  Description of Artificial Sequence: Synthetic oligonucleotide
tggtcccagagacatgtatagcatggaaccaagtaa

SEQ ID NO: 2181 - DNA, 40 bp, Artificial Sequence
  Description of Artificial Sequence: Synthetic oligonucleotide
tggtcccagagacatgtatagcatggaaccaagtaacatt

SEQ ID NO: 2182 - DNA, 22 bp, Artificial Sequence
  Description of Artificial Sequence: Synthetic oligonucleotide
tggttccatgctatacatgtct

SEQ ID NO: 2183 - DNA, 26 bp, Artificial Sequence
  Description of Artificial Sequence: Synthetic oligonucleotide
tggttccatgctatacatgtctctgg

SEQ ID NO: 2184 - DNA, 30 bp, Artificial Sequence
  Description of Artificial Sequence: Synthetic oligonucleotide
tggttccatgctatacatgtctctgggacc

SEQ ID NO: 2185 - DNA, 34 bp, Artificial Sequence
  Description of Artificial Sequence: Synthetic oligonucleotide
tggttccatgctatacatgtctctgggaccaatg

SEQ ID NO: 2186 - DNA, 38 bp, Artificial Sequence
  Description of Artificial Sequence: Synthetic oligonucleotide
tggttccatgctatacatgtctctgggaccaatggtac

SEQ ID NO: 2187 - DNA, 28 bp, Artificial Sequence
  Description of Artificial Sequence: Synthetic oligonucleotide
tgttacttggttccatgctatacatgtc

SEQ ID NO: 2188 - DNA, 32 bp, Artificial Sequence
  Description of Artificial Sequence: Synthetic oligonucleotide
tgttacttggttccatgctatacatgtctctg

SEQ ID NO: 2189 - DNA, 36 bp, Artificial Sequence
  Description of Artificial Sequence: Synthetic oligonucleotide
tgttacttggttccatgctatacatgtctctgggac

SEQ ID NO: 2190 - DNA, 40 bp, Artificial Sequence
  Description of Artificial Sequence: Synthetic oligonucleotide
tgttacttggttccatgctatacatgtctctgggaccaat

SEQ ID NO: 2191 - DNA, 27 bp, Artificial Sequence
  Description of Artificial Sequence: Synthetic oligonucleotide
ttacttggttccatgctatacatgtct

SEQ ID NO: 2192 - DNA, 31 bp, Artificial Sequence
  Description of Artificial Sequence: Synthetic oligonucleotide
ttacttggttccatgctatacatgtctctgg

SEQ ID NO: 2193 - DNA, 35 bp, Artificial Sequence
  Description of Artificial Sequence: Synthetic oligonucleotide
ttacttggttccatgctatacatgtctctgggacc

SEQ ID NO: 2194 - DNA, 39 bp, Artificial Sequence
  Description of Artificial Sequence: Synthetic oligonucleotide
ttacttggttccatgctatacatgtctctgggaccaatg

SEQ ID NO: 2195 - DNA, 34 bp, Artificial Sequence
  Description of Artificial Sequence: Synthetic oligonucleotide
ttagtaccattggtcccagagacatgtatagcat

SEQ ID NO: 2196 - DNA, 38 bp, Artificial Sequence
  Description of Artificial Sequence: Synthetic oligonucleotide
ttagtaccattggtcccagagacatgtatagcatggaa

SEQ ID NO: 2197 - DNA, 33 bp, Artificial Sequence
  Description of Artificial Sequence: Synthetic oligonucleotide
ttccaatgttacttggttccatgctatacatgt

SEQ ID NO: 2198 - DNA, 37 bp, Artificial Sequence
  Description of Artificial Sequence: Synthetic oligonucleotide
ttccaatgttacttggttccatgctatacatgtctct

SEQ ID NO: 2199 - DNA, 16 bp, Artificial Sequence
  Description of Artificial Sequence: Synthetic oligonucleotide
ttccatgctatacatg

SEQ ID NO: 2200 - DNA, 20 bp, Artificial Sequence
  Description of Artificial Sequence: Synthetic oligonucleotide
ttccatgctatacatgtctc

SEQ ID NO: 2201 - DNA, 24 bp, Artificial Sequence
  Description of Artificial Sequence: Synthetic oligonucleotide
ttccatgctatacatgtctctggg

SEQ ID NO: 2202 - DNA, 28 bp, Artificial Sequence
  Description of Artificial Sequence: Synthetic oligonucleotide
ttccatgctatacatgtctctgggacca

SEQ ID NO: 2203 - DNA, 32 bp, Artificial Sequence
  Description of Artificial Sequence: Synthetic oligonucleotide
ttccatgctatacatgtctctgggaccaatgg

SEQ ID NO: 2204 - DNA, 36 bp, Artificial Sequence
  Description of Artificial Sequence: Synthetic oligonucleotide
ttccatgctatacatgtctctgggaccaatggtact

SEQ ID NO: 2205 - DNA, 40 bp, Artificial Sequence
  Description of Artificial Sequence: Synthetic oligonucleotide
ttccatgctatacatgtctctgggaccaatggtactaaga

SEQ ID NO: 2206 - DNA, 40 bp, Artificial Sequence
  Description of Artificial Sequence: Synthetic oligonucleotide
ttcttttccaatgttacttggttccatgctatacatgtct

SEQ ID NO: 2207 - DNA, 26 bp, Artificial Sequence
  Description of Artificial Sequence: Synthetic oligonucleotide
ttggtcccagagacatgtatagcatg

SEQ ID NO: 2208 - DNA, 30 bp, Artificial Sequence
  Description of Artificial Sequence: Synthetic oligonucleotide
ttggtcccagagacatgtatagcatggaac

SEQ ID NO: 2209 - DNA, 34 bp, Artificial Sequence
  Description of Artificial Sequence: Synthetic oligonucleotide
ttggtcccagagacatgtatagcatggaaccaag

SEQ ID NO: 2210 - DNA, 38 bp, Artificial Sequence
  Description of Artificial Sequence: Synthetic oligonucleotide
ttggtcccagagacatgtatagcatggaaccaagtaac

SEQ ID NO: 2211 - DNA, 21 bp, Artificial Sequence
  Description of Artificial Sequence: Synthetic oligonucleotide
ttggttccatgctatacatgt

SEQ ID NO: 2212 - DNA, 25 bp, Artificial Sequence
  Description of Artificial Sequence: Synthetic oligonucleotide
ttggttccatgctatacatgtctct

SEQ ID NO: 2213 - DNA, 29 bp, Artificial Sequence
  Description of Artificial Sequence: Synthetic oligonucleotide
ttggttccatgctatacatgtctctggga

SEQ ID NO: 2214 - DNA, 33 bp, Artificial Sequence
  Description of Artificial Sequence: Synthetic oligonucleotide
ttggttccatgctatacatgtctctgggaccaa

SEQ ID NO: 2215 - DNA, 37 bp, Artificial Sequence
  Description of Artificial Sequence: Synthetic oligonucleotide
ttggttccatgctatacatgtctctgggaccaatggt

SEQ ID NO: 2216 - DNA, 33 bp, Artificial Sequence
  Description of Artificial Sequence: Synthetic oligonucleotide
tttccaatgttacttggttccatgctatacatg

SEQ ID NO: 2217 - DNA, 37 bp, Artificial Sequence
  Description of Artificial Sequence: Synthetic oligonucleotide
tttccaatgttacttggttccatgctatacatgtctc

SEQ ID NO: 2218 - DNA, 38 bp, Artificial Sequence
  Description of Artificial Sequence: Synthetic oligonucleotide
tttcttttccaatgttacttggttccatgctatacatg

SEQ ID NO: 2219 - DNA, 35 bp, Artificial Sequence
  Description of Artificial Sequence: Synthetic oligonucleotide
ttttccaatgttacttggttccatgctatacatgt

SEQ ID NO: 2220 - DNA, 39 bp, Artificial Sequence
  Description of Artificial Sequence: Synthetic oligonucleotide
ttttccaatgttacttggttccatgctatacatgtctct

SEQ ID NO: 2221 - DNA, 23 bp, Artificial Sequence
  Description of Artificial Sequence: Synthetic oligonucleotide
aagctggttcaatctgtcaagca

SEQ ID NO: 2222 - DNA, 27 bp, Artificial Sequence
  Description of Artificial Sequence: Synthetic oligonucleotide
aagctggttcaatctgtcaagcagcag

SEQ ID NO: 2223 - DNA, 31 bp, Artificial Sequence
  Description of Artificial Sequence: Synthetic oligonucleotide
aagctggttcaatctgtcaagcagcagcaaa

SEQ ID NO: 2224 - DNA, 13 bp, Artificial Sequence
  Description of Artificial Sequence: Synthetic oligonucleotide
aatctgtcaagca

SEQ ID NO: 2225 - DNA, 17 bp, Artificial Sequence
  Description of Artificial Sequence: Synthetic oligonucleotide
aatctgtcaagcagcag

SEQ ID NO: 2226 - DNA, 21 bp, Artificial Sequence
  Description of Artificial Sequence: Synthetic oligonucleotide
aatctgtcaagcagcagcaaa

SEQ ID NO: 2227 - DNA, 25 bp, Artificial Sequence
  Description of Artificial Sequence: Synthetic oligonucleotide
aatctgtcaagcagcagcaaagcaa

SEQ ID NO: 2228 - DNA, 29 bp, Artificial Sequence
  Description of Artificial Sequence: Synthetic oligonucleotide
aatctgtcaagcagcagcaaagcaagagc

SEQ ID NO: 2229 - DNA, 34 bp, Artificial Sequence
  Description of Artificial Sequence: Synthetic oligonucleotide
acattttgctctcaagctggttcaatctgtcaag

SEQ ID NO: 2230 - DNA, 38 bp, Artificial Sequence
  Description of Artificial Sequence: Synthetic oligonucleotide
acattttgctctcaagctggttcaatctgtcaagcagc

SEQ ID NO: 2231 - DNA, 36 bp, Artificial Sequence
  Description of Artificial Sequence: Synthetic oligonucleotide
agacattttgctctcaagctggttcaatctgtcaag

SEQ ID NO: 2232 - DNA, 40 bp, Artificial Sequence
  Description of Artificial Sequence: Synthetic oligonucleotide
agacattttgctctcaagctggttcaatctgtcaagcagc

SEQ ID NO: 2233 - DNA, 23 bp, Artificial Sequence
  Description of Artificial Sequence: Synthetic oligonucleotide
agctggttcaatctgtcaagcag

SEQ ID NO: 2234 - DNA, 27 bp, Artificial Sequence
  Description of Artificial Sequence: Synthetic oligonucleotide
agctggttcaatctgtcaagcagcagc

SEQ ID NO: 2235 - DNA, 31 bp, Artificial Sequence
  Description of Artificial Sequence: Synthetic oligonucleotide
agctggttcaatctgtcaagcagcagcaaag

SEQ ID NO: 2236 - DNA, 14 bp, Artificial Sequence
  Description of Artificial Sequence: Synthetic oligonucleotide
atctgtcaagcagc

SEQ ID NO: 2237 - DNA, 18 bp, Artificial Sequence
  Description of Artificial Sequence: Synthetic oligonucleotide
atctgtcaagcagcagca

SEQ ID NO: 2238 - DNA, 22 bp, Artificial Sequence
  Description of Artificial Sequence: Synthetic oligonucleotide
atctgtcaagcagcagcaaagc

SEQ ID NO: 2239 - DNA, 26 bp, Artificial Sequence
  Description of Artificial Sequence: Synthetic oligonucleotide
atctgtcaagcagcagcaaagcaaga

SEQ ID NO: 2240 - DNA, 30 bp, Artificial Sequence
  Description of Artificial Sequence: Synthetic oligonucleotide
atctgtcaagcagcagcaaagcaagagcag

SEQ ID NO: 2241 - DNA, 34 bp, Artificial Sequence
  Description of Artificial Sequence: Synthetic oligonucleotide
attttgctctcaagctggttcaatctgtcaagca

SEQ ID NO: 2242 - DNA, 38 bp, Artificial Sequence
  Description of Artificial Sequence: Synthetic oligonucleotide
attttgctctcaagctggttcaatctgtcaagcagcag

SEQ ID NO: 2243 - DNA, 25 bp, Artificial Sequence
  Description of Artificial Sequence: Synthetic oligonucleotide
caagctggttcaatctgtcaagcag

SEQ ID NO: 2244 - DNA, 29 bp, Artificial Sequence
  Description of Artificial Sequence: Synthetic oligonucleotide
caagctggttcaatctgtcaagcagcagc

SEQ ID NO: 2245 - DNA, 33 bp, Artificial Sequence
  Description of Artificial Sequence: Synthetic oligonucleotide
caagctggttcaatctgtcaagcagcagcaaag

SEQ ID NO: 2246 - DNA, 15 bp, Artificial Sequence
  Description of Artificial Sequence: Synthetic oligonucleotide
caatctgtcaagcag

SEQ ID NO: 2247 - DNA, 19 bp, Artificial Sequence
  Description of Artificial Sequence: Synthetic oligonucleotide
caatctgtcaagcagcagc

SEQ ID NO: 2248 - DNA, 23 bp, Artificial Sequence
  Description of Artificial Sequence: Synthetic oligonucleotide
caatctgtcaagcagcagcaaag

SEQ ID NO: 2249 - DNA, 27 bp, Artificial Sequence
  Description of Artificial Sequence: Synthetic oligonucleotide
caatctgtcaagcagcagcaaagcaag

SEQ ID NO: 2250 - DNA, 31 bp, Artificial Sequence
  Description of Artificial Sequence: Synthetic oligonucleotide
caatctgtcaagcagcagcaaagcaagagca

SEQ ID NO: 2251 - DNA, 38 bp, Artificial Sequence
  Description of Artificial Sequence: Synthetic oligonucleotide
cagacattttgctctcaagctggttcaatctgtcaagc

SEQ ID NO: 2252 - DNA, 34 bp, Artificial Sequence
  Description of Artificial Sequence: Synthetic oligonucleotide
cattttgctctcaagctggttcaatctgtcaagc

SEQ ID NO: 2253 - DNA, 38 bp, Artificial Sequence
  Description of Artificial Sequence: Synthetic oligonucleotide
cattttgctctcaagctggttcaatctgtcaagcagca

SEQ ID NO: 2254 - DNA, 40 bp, Artificial Sequence
  Description of Artificial Sequence: Synthetic oligonucleotide
ccagacattttgctctcaagctggttcaatctgtcaagca

SEQ ID NO: 2255 - DNA, 27 bp, Artificial Sequence
  Description of Artificial Sequence: Synthetic oligonucleotide
ctcaagctggttcaatctgtcaagcag

SEQ ID NO: 2256 - DNA, 31 bp, Artificial Sequence
  Description of Artificial Sequence: Synthetic oligonucleotide
ctcaagctggttcaatctgtcaagcagcagc

SEQ ID NO: 2257 - DNA, 35 bp, Artificial Sequence
  Description of Artificial Sequence: Synthetic oligonucleotide
ctcaagctggttcaatctgtcaagcagcagcaaag

SEQ ID NO: 2258 - DNA, 29 bp, Artificial Sequence
  Description of Artificial Sequence: Synthetic oligonucleotide
ctctcaagctggttcaatctgtcaagcag

SEQ ID NO: 2259 - DNA, 33 bp, Artificial Sequence
  Description of Artificial Sequence: Synthetic oligonucleotide
ctctcaagctggttcaatctgtcaagcagcagc

SEQ ID NO: 2260 - DNA, 37 bp, Artificial Sequence
  Description of Artificial Sequence: Synthetic oligonucleotide
ctctcaagctggttcaatctgtcaagcagcagcaaag

SEQ ID NO: 2261 - DNA, 30 bp, Artificial Sequence
  Description of Artificial Sequence: Synthetic oligonucleotide
ctcttgctttgctgctgcttgacagattga

SEQ ID NO: 2262 - DNA, 34 bp, Artificial Sequence
  Description of Artificial Sequence: Synthetic oligonucleotide
ctcttgctttgctgctgcttgacagattgaacca

SEQ ID NO: 2263 - DNA, 32 bp, Artificial Sequence
  Description of Artificial Sequence: Synthetic oligonucleotide
ctgctcttgctttgctgctgcttgacagattg

SEQ ID NO: 2264 - DNA, 16 bp, Artificial Sequence
  Description of Artificial Sequence: Synthetic oligonucleotide
ctgctgcttgacagat

SEQ ID NO: 2265 - DNA, 20 bp, Artificial Sequence
  Description of Artificial Sequence: Synthetic oligonucleotide
ctgctgcttgacagattgaa

SEQ ID NO: 2266 - DNA, 24 bp, Artificial Sequence
  Description of Artificial Sequence: Synthetic oligonucleotide
ctgctgcttgacagattgaaccag

SEQ ID NO: 2267 - DNA, 28 bp, Artificial Sequence
  Description of Artificial Sequence: Synthetic oligonucleotide
ctgctgcttgacagattgaaccagcttg

SEQ ID NO: 2268 - DNA, 32 bp, Artificial Sequence
  Description of Artificial Sequence: Synthetic oligonucleotide
ctgctgcttgacagattgaaccagcttgagag

SEQ ID NO: 2269 - DNA, 36 bp, Artificial Sequence
  Description of Artificial Sequence: Synthetic oligonucleotide
ctgctgcttgacagattgaaccagcttgagagcaaa

SEQ ID NO: 2270 - DNA, 14 bp, Artificial Sequence
  Description of Artificial Sequence: Synthetic oligonucleotide
ctgcttgacagatt

SEQ ID NO: 2271 - DNA, 18 bp, Artificial Sequence
  Description of Artificial Sequence: Synthetic oligonucleotide
ctgcttgacagattgaac

SEQ ID NO: 2272 - DNA, 22 bp, Artificial Sequence
  Description of Artificial Sequence: Synthetic oligonucleotide
ctgcttgacagattgaaccagc

SEQ ID NO: 2273 - DNA, 26 bp, Artificial Sequence
  Description of Artificial Sequence: Synthetic oligonucleotide
ctgcttgacagattgaaccagcttga

SEQ ID NO: 2274 - DNA, 30 bp, Artificial Sequence
  Description of Artificial Sequence: Synthetic oligonucleotide
ctgcttgacagattgaaccagcttgagagc

SEQ ID NO: 2275 - DNA, 34 bp, Artificial Sequence
  Description of Artificial Sequence: Synthetic oligonucleotide
ctgcttgacagattgaaccagcttgagagcaaaa

SEQ ID NO: 2276 - DNA, 38 bp, Artificial Sequence
  Description of Artificial Sequence: Synthetic oligonucleotide
ctgcttgacagattgaaccagcttgagagcaaaatgtc

SEQ ID NO: 2277 - DNA, 19 bp, Artificial Sequence
  Description of Artificial Sequence: Synthetic oligonucleotide
ctggttcaatctgtcaagc

SEQ ID NO: 2278 - DNA, 23 bp, Artificial Sequence
  Description of Artificial Sequence: Synthetic oligonucleotide
ctggttcaatctgtcaagcagca

SEQ ID NO: 2279 - DNA, 27 bp, Artificial Sequence
  Description of Artificial Sequence: Synthetic oligonucleotide
ctggttcaatctgtcaagcagcagcaa

SEQ ID NO: 2280 - DNA, 31 bp, Artificial Sequence
  Description of Artificial Sequence: Synthetic oligonucleotide
ctggttcaatctgtcaagcagcagcaaagca

SEQ ID NO: 2281 - DNA, 35 bp, Artificial Sequence
  Description of Artificial Sequence: Synthetic oligonucleotide
ctggttcaatctgtcaagcagcagcaaagcaagag

SEQ ID NO: 2282 - DNA, 15 bp, Artificial Sequence
  Description of Artificial Sequence: Synthetic oligonucleotide
cttgacagattgaac

SEQ ID NO: 2283 - DNA, 19 bp, Artificial Sequence
  Description of Artificial Sequence: Synthetic oligonucleotide
cttgacagattgaaccagc

SEQ ID NO: 2284 - DNA, 23 bp, Artificial Sequence
  Description of Artificial Sequence: Synthetic oligonucleotide
cttgacagattgaaccagcttga

SEQ ID NO: 2285 - DNA, 27 bp, Artificial Sequence
  Description of Artificial Sequence: Synthetic oligonucleotide
cttgacagattgaaccagcttgagagc

SEQ ID NO: 2286 - DNA, 31 bp, Artificial Sequence
  Description of Artificial Sequence: Synthetic oligonucleotide
cttgacagattgaaccagcttgagagcaaaa

SEQ ID NO: 2287 - DNA, 35 bp, Artificial Sequence
  Description of Artificial Sequence: Synthetic oligonucleotide
cttgacagattgaaccagcttgagagcaaaatgtc

SEQ ID NO: 2288 - DNA, 39 bp, Artificial Sequence
  Description of Artificial Sequence: Synthetic oligonucleotide
cttgacagattgaaccagcttgagagcaaaatgtctggt

SEQ ID NO: 2289 - DNA, 27 bp, Artificial Sequence
  Description of Artificial Sequence: Synthetic oligonucleotide
cttgctttgctgctgcttgacagattg

SEQ ID NO: 2290 - DNA, 31 bp, Artificial Sequence
  Description of Artificial Sequence: Synthetic oligonucleotide
cttgctttgctgctgcttgacagattgaacc

SEQ ID NO: 2291 - DNA, 36 bp, Artificial Sequence
  Description of Artificial Sequence: Synthetic oligonucleotide
cttgctttgctgctgcttgacagattgaaccagctt

SEQ ID NO: 2292 - DNA, 23 bp, Artificial Sequence
  Description of Artificial Sequence: Synthetic oligonucleotide
ctttgctgctgcttgacagattg

SEQ ID NO: 2293 - DNA, 27 bp, Artificial Sequence
  Description of Artificial Sequence: Synthetic oligonucleotide
ctttgctgctgcttgacagattgaacc

SEQ ID NO: 2294 - DNA, 31 bp, Artificial Sequence
  Description of Artificial Sequence: Synthetic oligonucleotide
ctttgctgctgcttgacagattgaaccagct

SEQ ID NO: 2295 - DNA, 35 bp, Artificial Sequence
  Description of Artificial Sequence: Synthetic oligonucleotide
ctttgctgctgcttgacagattgaaccagcttgag

SEQ ID NO: 2296 - DNA, 23 bp, Artificial Sequence
  Description of Artificial Sequence: Synthetic oligonucleotide
tcaagctggttcaatctgtcaag

SEQ ID NO: 2297 - DNA, 27 bp, Artificial Sequence
  Description of Artificial Sequence: Synthetic oligonucleotide
tcaagctggttcaatctgtcaagcagc

SEQ ID NO: 2298 - DNA, 31 bp, Artificial Sequence
  Description of Artificial Sequence: Synthetic oligonucleotide
tcaagctggttcaatctgtcaagcagcagca

SEQ ID NO: 2299 - DNA, 14 bp, Artificial Sequence
  Description of Artificial Sequence: Synthetic oligonucleotide
tcaatctgtcaagc

SEQ ID NO: 2300 - DNA, 18 bp, Artificial Sequence
  Description of Artificial Sequence: Synthetic oligonucleotide
tcaatctgtcaagcagca

SEQ ID NO: 2301 - DNA, 22 bp, Artificial Sequence
  Description of Artificial Sequence: Synthetic oligonucleotide
tcaatctgtcaagcagcagcaa

SEQ ID NO: 2302 - DNA, 26 bp, Artificial Sequence
  Description of Artificial Sequence: Synthetic oligonucleotide
tcaatctgtcaagcagcagcaaagca

SEQ ID NO: 2303 - DNA, 30 bp, Artificial Sequence
  Description of Artificial Sequence: Synthetic oligonucleotide
tcaatctgtcaagcagcagcaaagcaagag

SEQ ID NO: 2304 - DNA, 25 bp, Artificial Sequence
  Description of Artificial Sequence: Synthetic oligonucleotide
tctcaagctggttcaatctgtcaag

SEQ ID NO: 2305 - DNA, 29 bp, Artificial Sequence
  Description of Artificial Sequence: Synthetic oligonucleotide
tctcaagctggttcaatctgtcaagcagc

SEQ ID NO: 2306 - DNA, 33 bp, Artificial Sequence
  Description of Artificial Sequence: Synthetic oligonucleotide
tctcaagctggttcaatctgtcaagcagcagca

SEQ ID NO: 2307 - DNA, 26 bp, Artificial Sequence
  Description of Artificial Sequence: Synthetic oligonucleotide
tcttgctttgctgctgcttgacagat

SEQ ID NO: 2308 - DNA, 30 bp, Artificial Sequence
  Description of Artificial Sequence: Synthetic oligonucleotide
tcttgctttgctgctgcttgacagattgaa

SEQ ID NO: 2309 - DNA, 34 bp, Artificial Sequence
  Description of Artificial Sequence: Synthetic oligonucleotide
tcttgctttgctgctgcttgacagattgaaccag

SEQ ID NO: 2310 - DNA, 31 bp, Artificial Sequence
  Description of Artificial Sequence: Synthetic oligonucleotide
tgctctcaagctggttcaatctgtcaagcag

SEQ ID NO: 2311 - DNA, 29 bp, Artificial Sequence
  Description of Artificial Sequence: Synthetic oligonucleotide
tgctcttgctttgctgctgcttgacagat

SEQ ID NO: 2312 - DNA, 33 bp, Artificial Sequence
  Description of Artificial Sequence: Synthetic oligonucleotide
tgctcttgctttgctgctgcttgacagattgaa

SEQ ID NO: 2313 - DNA, 20 bp, Artificial Sequence
  Description of Artificial Sequence: Synthetic oligonucleotide
tgctgctgcttgacagattg

SEQ ID NO: 2314 - DNA, 24 bp, Artificial Sequence
  Description of Artificial Sequence: Synthetic oligonucleotide
tgctgctgcttgacagattgaacc

SEQ ID NO: 2315 - DNA, 28 bp, Artificial Sequence
  Description of Artificial Sequence: Synthetic oligonucleotide
tgctgctgcttgacagattgaaccagct

SEQ ID NO: 2316 - DNA, 32 bp, Artificial Sequence
  Description of Artificial Sequence: Synthetic oligonucleotide
tgctgctgcttgacagattgaaccagcttgag

SEQ ID NO: 2317 - DNA, 16 bp, Artificial Sequence
  Description of Artificial Sequence: Synthetic oligonucleotide
tgctgcttgacagatt

SEQ ID NO: 2318 - DNA, 20 bp, Artificial Sequence
  Description of Artificial Sequence: Synthetic oligonucleotide
tgctgcttgacagattgaac

SEQ ID NO: 2319 - DNA, 24 bp, Artificial Sequence
  Description of Artificial Sequence: Synthetic oligonucleotide
tgctgcttgacagattgaaccagc

SEQ ID NO: 2320 - DNA, 28 bp, Artificial Sequence
  Description of Artificial Sequence: Synthetic oligonucleotide
tgctgcttgacagattgaaccagcttga

SEQ ID NO: 2321 - DNA, 32 bp, Artificial Sequence
  Description of Artificial Sequence: Synthetic oligonucleotide
tgctgcttgacagattgaaccagcttgagagc

SEQ ID NO: 2322 - DNA, 36 bp, Artificial Sequence
  Description of Artificial Sequence: Synthetic oligonucleotide
tgctgcttgacagattgaaccagcttgagagcaaaa

SEQ ID NO: 2323 - DNA, 14 bp, Artificial Sequence
  Description of Artificial Sequence: Synthetic oligonucleotide
tgcttgacagattg

SEQ ID NO: 2324 - DNA, 18 bp, Artificial Sequence
  Description of Artificial Sequence: Synthetic oligonucleotide
tgcttgacagattgaacc

SEQ ID NO: 2325 - DNA, 22 bp, Artificial Sequence
  Description of Artificial Sequence: Synthetic oligonucleotide
tgcttgacagattgaaccagct

SEQ ID NO: 2326 - DNA, 26 bp, Artificial Sequence
  Description of Artificial Sequence: Synthetic oligonucleotide
tgcttgacagattgaaccagcttgag

SEQ ID NO: 2327 - DNA, 30 bp, Artificial Sequence
  Description of Artificial Sequence: Synthetic oligonucleotide
tgcttgacagattgaaccagcttgagagca

SEQ ID NO: 2328 - DNA, 34 bp, Artificial Sequence
  Description of Artificial Sequence: Synthetic oligonucleotide
tgcttgacagattgaaccagcttgagagcaaaat

SEQ ID NO: 2329 - DNA, 38 bp, Artificial Sequence
  Description of Artificial Sequence: Synthetic oligonucleotide
tgcttgacagattgaaccagcttgagagcaaaatgtct

SEQ ID NO: 2330 - DNA, 25 bp, Artificial Sequence
  Description of Artificial Sequence: Synthetic oligonucleotide
tgctttgctgctgcttgacagattg

SEQ ID NO: 2331 - DNA, 29 bp, Artificial Sequence
  Description of Artificial Sequence: Synthetic oligonucleotide
tgctttgctgctgcttgacagattgaacc

SEQ ID NO: 2332 - DNA, 34 bp, Artificial Sequence
  Description of Artificial Sequence: Synthetic oligonucleotide
tgctttgctgctgcttgacagattgaaccagctt

SEQ ID NO: 2333 - DNA, 19 bp, Artificial Sequence
  Description of Artificial Sequence: Synthetic oligonucleotide
tggttcaatctgtcaagca

SEQ ID NO: 2334 - DNA, 23 bp, Artificial Sequence
  Description of Artificial Sequence: Synthetic oligonucleotide
tggttcaatctgtcaagcagcag

SEQ ID NO: 2335 - DNA, 27 bp, Artificial Sequence
  Description of Artificial Sequence: Synthetic oligonucleotide
tggttcaatctgtcaagcagcagcaaa

SEQ ID NO: 2336 - DNA, 31 bp, Artificial Sequence
  Description of Artificial Sequence: Synthetic oligonucleotide
tggttcaatctgtcaagcagcagcaaagcaa

SEQ ID NO: 2337 - DNA, 35 bp, Artificial Sequence
  Description of Artificial Sequence: Synthetic oligonucleotide
tggttcaatctgtcaagcagcagcaaagcaagagc

SEQ ID NO: 2338 - DNA, 17 bp, Artificial Sequence
  Description of Artificial Sequence: Synthetic oligonucleotide
ttcaatctgtcaagcag

SEQ ID NO: 2339 - DNA, 21 bp, Artificial Sequence
  Description of Artificial Sequence: Synthetic oligonucleotide
ttcaatctgtcaagcagcagc

SEQ ID NO: 2340 - DNA, 25 bp, Artificial Sequence
  Description of Artificial Sequence: Synthetic oligonucleotide
ttcaatctgtcaagcagcagcaaag

SEQ ID NO: 2341 - DNA, 29 bp, Artificial Sequence
  Description of Artificial Sequence: Synthetic oligonucleotide
ttcaatctgtcaagcagcagcaaagcaag

SEQ ID NO: 2342 - DNA, 33 bp, Artificial Sequence
  Description of Artificial Sequence: Synthetic oligonucleotide
ttcaatctgtcaagcagcagcaaagcaagagca

SEQ ID NO: 2343 - DNA, 31 bp, Artificial Sequence
  Description of Artificial Sequence: Synthetic oligonucleotide
ttgctctcaagctggttcaatctgtcaagca

SEQ ID NO: 2344 - DNA, 35 bp, Artificial Sequence
  Description of Artificial Sequence: Synthetic oligonucleotide
ttgctctcaagctggttcaatctgtcaagcagcag

SEQ ID NO: 2345 - DNA, 22 bp, Artificial Sequence
  Description of Artificial Sequence: Synthetic oligonucleotide
ttgctgctgcttgacagattga

SEQ ID NO: 2346 - DNA, 26 bp, Artificial Sequence
  Description of Artificial Sequence: Synthetic oligonucleotide
ttgctgctgcttgacagattgaacca

SEQ ID NO: 2347 - DNA, 30 bp, Artificial Sequence
  Description of Artificial Sequence: Synthetic oligonucleotide
ttgctgctgcttgacagattgaaccagctt

SEQ ID NO: 2348 - DNA, 34 bp, Artificial Sequence
  Description of Artificial Sequence: Synthetic oligonucleotide
ttgctgctgcttgacagattgaaccagcttgaga

SEQ ID NO: 2349 - DNA, 26 bp, Artificial Sequence
  Description of Artificial Sequence: Synthetic oligonucleotide
ttgctttgctgctgcttgacagattg

SEQ ID NO: 2350 - DNA, 30 bp, Artificial Sequence
  Description of Artificial Sequence: Synthetic oligonucleotide
ttgctttgctgctgcttgacagattgaacc

SEQ ID NO: 2351 - DNA, 35 bp, Artificial Sequence
  Description of Artificial Sequence: Synthetic oligonucleotide
ttgctttgctgctgcttgacagattgaaccagctt

SEQ ID NO: 2352 - DNA, 32 bp, Artificial Sequence
  Description of Artificial Sequence: Synthetic oligonucleotide
tttgctctcaagctggttcaatctgtcaagca

SEQ ID NO: 2353 - DNA, 36 bp, Artificial Sequence
  Description of Artificial Sequence: Synthetic oligonucleotide
tttgctctcaagctggttcaatctgtcaagcagcag

SEQ ID NO: 2354 - DNA, 23 bp, Artificial Sequence
  Description of Artificial Sequence: Synthetic oligonucleotide
tttgctgctgcttgacagattga

SEQ ID NO: 2355 - DNA, 27 bp, Artificial Sequence
  Description of Artificial Sequence: Synthetic oligonucleotide
tttgctgctgcttgacagattgaacca

SEQ ID NO: 2356 - DNA, 31 bp, Artificial Sequence
  Description of Artificial Sequence: Synthetic oligonucleotide
tttgctgctgcttgacagattgaaccagctt

SEQ ID NO: 2357 - DNA, 35 bp, Artificial Sequence
  Description of Artificial Sequence: Synthetic oligonucleotide
tttgctgctgcttgacagattgaaccagcttgaga

SEQ ID NO: 2358 - DNA, 33 bp, Artificial Sequence
  Description of Artificial Sequence: Synthetic oligonucleotide
ttttgctctcaagctggttcaatctgtcaagca

SEQ ID NO: 2359 - DNA, 37 bp, Artificial Sequence
  Description of Artificial Sequence: Synthetic oligonucleotide
ttttgctctcaagctggttcaatctgtcaagcagcag

SEQ ID NO: 2360 - DNA, 18 bp, Artificial Sequence
  Description of Artificial Sequence: Synthetic oligonucleotide
aaatcctaaaattccctt

SEQ ID NO: 2361 - DNA, 22 bp, Artificial Sequence
  Description of Artificial Sequence: Synthetic oligonucleotide
aaatcctaaaattcccttagtc

SEQ ID NO: 2362 - DNA, 26 bp, Artificial Sequence
  Description of Artificial Sequence: Synthetic oligonucleotide
aaatcctaaaattcccttagtcagag

SEQ ID NO: 2363 - DNA, 30 bp, Artificial Sequence
  Description of Artificial Sequence: Synthetic oligonucleotide
aaatcctaaaattcccttagtcagaggtga

SEQ ID NO: 2364 - DNA, 34 bp, Artificial Sequence
  Description of Artificial Sequence: Synthetic oligonucleotide
aaatcctaaaattcccttagtcagaggtgacaag

SEQ ID NO: 2365 - DNA, 38 bp, Artificial Sequence
  Description of Artificial Sequence: Synthetic oligonucleotide
aaatcctaaaattcccttagtcagaggtgacaagattg

SEQ ID NO: 2366 - DNA, 19 bp, Artificial Sequence
  Description of Artificial Sequence: Synthetic oligonucleotide
aacacaaatcctaaaattc

SEQ ID NO: 2367 - DNA, 23 bp, Artificial Sequence
  Description of Artificial Sequence: Synthetic oligonucleotide
aacacaaatcctaaaattccctt

SEQ ID NO: 2368 - DNA, 27 bp, Artificial Sequence
  Description of Artificial Sequence: Synthetic oligonucleotide
aacacaaatcctaaaattcccttagtc

SEQ ID NO: 2369 - DNA, 31 bp, Artificial Sequence
  Description of Artificial Sequence: Synthetic oligonucleotide
aacacaaatcctaaaattcccttagtcagag

SEQ ID NO: 2370 - DNA, 35 bp, Artificial Sequence
  Description of Artificial Sequence: Synthetic oligonucleotide
aacacaaatcctaaaattcccttagtcagaggtga

SEQ ID NO: 2371 - DNA, 39 bp, Artificial Sequence
  Description of Artificial Sequence: Synthetic oligonucleotide
aacacaaatcctaaaattcccttagtcagaggtgacaag

SEQ ID NO: 2372 - DNA, 16 bp, Artificial Sequence
  Description of Artificial Sequence: Synthetic oligonucleotide
aagggaattttaggat

SEQ ID NO: 2373 - DNA, 20 bp, Artificial Sequence
  Description of Artificial Sequence: Synthetic oligonucleotide
aagggaattttaggatttgt

SEQ ID NO: 2374 - DNA, 24 bp, Artificial Sequence
  Description of Artificial Sequence: Synthetic oligonucleotide
aagggaattttaggatttgtgttc

SEQ ID NO: 2375 - DNA, 28 bp, Artificial Sequence
  Description of Artificial Sequence: Synthetic oligonucleotide
aagggaattttaggatttgtgttcacgc

SEQ ID NO: 2376 - DNA, 32 bp, Artificial Sequence
  Description of Artificial Sequence: Synthetic oligonucleotide
aagggaattttaggatttgtgttcacgctcac

SEQ ID NO: 2377 - DNA, 36 bp, Artificial Sequence
  Description of Artificial Sequence: Synthetic oligonucleotide
aagggaattttaggatttgtgttcacgctcaccgtg

SEQ ID NO: 2378 - DNA, 15 bp, Artificial Sequence
  Description of Artificial Sequence: Synthetic oligonucleotide
aatcctaaaattccc

SEQ ID NO: 2379 - DNA, 19 bp, Artificial Sequence
  Description of Artificial Sequence: Synthetic oligonucleotide
aatcctaaaattcccttag

SEQ ID NO: 2380 - DNA, 23 bp, Artificial Sequence
  Description of Artificial Sequence: Synthetic oligonucleotide
aatcctaaaattcccttagtcag

SEQ ID NO: 2381 - DNA, 27 bp, Artificial Sequence
  Description of Artificial Sequence: Synthetic oligonucleotide
aatcctaaaattcccttagtcagaggt

SEQ ID NO: 2382 - DNA, 31 bp, Artificial Sequence
  Description of Artificial Sequence: Synthetic oligonucleotide
aatcctaaaattcccttagtcagaggtgaca

SEQ ID NO: 2383 - DNA, 35 bp, Artificial Sequence
  Description of Artificial Sequence: Synthetic oligonucleotide
aatcctaaaattcccttagtcagaggtgacaagat

SEQ ID NO: 2384 - DNA, 39 bp, Artificial Sequence
  Description of Artificial Sequence: Synthetic oligonucleotide
aatcctaaaattcccttagtcagaggtgacaagattggt

SEQ ID NO: 2385 - DNA, 36 bp, Artificial Sequence
  Description of Artificial Sequence: Synthetic oligonucleotide
aatcttgtcacctctgactaagggaattttaggatt

SEQ ID NO: 2386 - DNA, 40 bp, Artificial Sequence
  Description of Artificial Sequence: Synthetic oligonucleotide
aatcttgtcacctctgactaagggaattttaggatttgtg

SEQ ID NO: 2387 - DNA, 18 bp, Artificial Sequence
  Description of Artificial Sequence: Synthetic oligonucleotide
aattttaggatttgtgtt

SEQ ID NO: 2388 - DNA, 22 bp, Artificial Sequence
  Description of Artificial Sequence: Synthetic oligonucleotide
aattttaggatttgtgttcacg

SEQ ID NO: 2389 - DNA, 26 bp, Artificial Sequence
  Description of Artificial Sequence: Synthetic oligonucleotide
aattttaggatttgtgttcacgctca

SEQ ID NO: 2390 - DNA, 30 bp, Artificial Sequence
  Description of Artificial Sequence: Synthetic oligonucleotide
aattttaggatttgtgttcacgctcaccgt

SEQ ID NO: 2391 - DNA, 34 bp, Artificial Sequence
  Description of Artificial Sequence: Synthetic oligonucleotide
aattttaggatttgtgttcacgctcaccgtgccc

SEQ ID NO: 2392 - DNA, 39 bp, Artificial Sequence
  Description of Artificial Sequence: Synthetic oligonucleotide
aattttaggatttgtgttcacgctcaccgtgcccagtga

SEQ ID NO: 2393 - DNA, 18 bp, Artificial Sequence
  Description of Artificial Sequence: Synthetic oligonucleotide
acaaatcctaaaattccc

SEQ ID NO: 2394 - DNA, 22 bp, Artificial Sequence
  Description of Artificial Sequence: Synthetic oligonucleotide
acaaatcctaaaattcccttag

SEQ ID NO: 2395 - DNA, 26 bp, Artificial Sequence
  Description of Artificial Sequence: Synthetic oligonucleotide
acaaatcctaaaattcccttagtcag

SEQ ID NO: 2396 - DNA, 30 bp, Artificial Sequence
  Description of Artificial Sequence: Synthetic oligonucleotide
acaaatcctaaaattcccttagtcagaggt

SEQ ID NO: 2397 - DNA, 34 bp, Artificial Sequence
  Description of Artificial Sequence: Synthetic oligonucleotide
acaaatcctaaaattcccttagtcagaggtgaca

SEQ ID NO: 2398 - DNA, 38 bp, Artificial Sequence
  Description of Artificial Sequence: Synthetic oligonucleotide
acaaatcctaaaattcccttagtcagaggtgacaagat

SEQ ID NO: 2399 - DNA, 18 bp, Artificial Sequence
  Description of Artificial Sequence: Synthetic oligonucleotide
acacaaatcctaaaattc

SEQ ID NO: 2400 - DNA, 22 bp, Artificial Sequence
  Description of Artificial Sequence: Synthetic oligonucleotide
acacaaatcctaaaattccctt

SEQ ID NO: 2401 - DNA, 26 bp, Artificial Sequence
  Description of Artificial Sequence: Synthetic oligonucleotide
acacaaatcctaaaattcccttagtc

SEQ ID NO: 2402 - DNA, 30 bp, Artificial Sequence
  Description of Artificial Sequence: Synthetic oligonucleotide
acacaaatcctaaaattcccttagtcagag

SEQ ID NO: 2403 - DNA, 34 bp, Artificial Sequence
  Description of Artificial Sequence: Synthetic oligonucleotide
acacaaatcctaaaattcccttagtcagaggtga

SEQ ID NO: 2404 - DNA, 38 bp, Artificial Sequence
  Description of Artificial Sequence: Synthetic oligonucleotide
acacaaatcctaaaattcccttagtcagaggtgacaag

SEQ ID NO: 2405 - DNA, 38 bp, Artificial Sequence
  Description of Artificial Sequence: Synthetic oligonucleotide
accaatcttgtcacctctgactaagggaattttaggat

SEQ ID NO: 2406 - DNA, 26 bp, Artificial Sequence
  Description of Artificial Sequence: Synthetic oligonucleotide
acctctgactaagggaattttaggat

SEQ ID NO: 2407 - DNA, 30 bp, Artificial Sequence
  Description of Artificial Sequence: Synthetic oligonucleotide
acctctgactaagggaattttaggatttgt

SEQ ID NO: 2408 - DNA, 34 bp, Artificial Sequence
  Description of Artificial Sequence: Synthetic oligonucleotide
acctctgactaagggaattttaggatttgtgttc

SEQ ID NO: 2409 - DNA, 38 bp, Artificial Sequence
  Description of Artificial Sequence: Synthetic oligonucleotide
acctctgactaagggaattttaggatttgtgttcacgc

SEQ ID NO: 2410 - DNA, 31 bp, Artificial Sequence
  Description of Artificial Sequence: Synthetic oligonucleotide
acggtgagcgtgaacacaaatcctaaaattc

SEQ ID NO: 2411 - DNA, 35 bp, Artificial Sequence
  Description of Artificial Sequence: Synthetic oligonucleotide
acggtgagcgtgaacacaaatcctaaaattccctt

SEQ ID NO: 2412 - DNA, 39 bp, Artificial Sequence
  Description of Artificial Sequence: Synthetic oligonucleotide
acggtgagcgtgaacacaaatcctaaaattcccttagtc

SEQ ID NO: 2413 - DNA, 20 bp, Artificial Sequence
  Description of Artificial Sequence: Synthetic oligonucleotide
actaagggaattttaggatt

SEQ ID NO: 2414 - DNA, 24 bp, Artificial Sequence
  Description of Artificial Sequence: Synthetic oligonucleotide
actaagggaattttaggatttgtg

SEQ ID NO: 2415 - DNA, 28 bp, Artificial Sequence
  Description of Artificial Sequence: Synthetic oligonucleotide
actaagggaattttaggatttgtgttca

SEQ ID NO: 2416 - DNA, 32 bp, Artificial Sequence
  Description of Artificial Sequence: Synthetic oligonucleotide
actaagggaattttaggatttgtgttcacgct

SEQ ID NO: 2417 - DNA, 36 bp, Artificial Sequence
  Description of Artificial Sequence: Synthetic oligonucleotide
actaagggaattttaggatttgtgttcacgctcacc

SEQ ID NO: 2418 - DNA, 40 bp, Artificial Sequence
  Description of Artificial Sequence: Synthetic oligonucleotide
actaagggaattttaggatttgtgttcacgctcaccgtgc

SEQ ID NO: 2419 - DNA, 25 bp, Artificial Sequence
  Description of Artificial Sequence: Synthetic oligonucleotide
agcgtgaacacaaatcctaaaattc

SEQ ID NO: 2420 - DNA, 29 bp, Artificial Sequence
  Description of Artificial Sequence: Synthetic oligonucleotide
agcgtgaacacaaatcctaaaattccctt

SEQ ID NO: 2421 - DNA, 33 bp, Artificial Sequence
  Description of Artificial Sequence: Synthetic oligonucleotide
agcgtgaacacaaatcctaaaattcccttagtc

SEQ ID NO: 2422 - DNA, 37 bp, Artificial Sequence
  Description of Artificial Sequence: Synthetic oligonucleotide
agcgtgaacacaaatcctaaaattcccttagtcagag

SEQ ID NO: 2423 - DNA, 14 bp, Artificial Sequence
  Description of Artificial Sequence: Synthetic oligonucleotide
agggaattttagga

SEQ ID NO: 2424 - DNA, 18 bp, Artificial Sequence
  Description of Artificial Sequence: Synthetic oligonucleotide
agggaattttaggatttg

SEQ ID NO: 2425 - DNA, 22 bp, Artificial Sequence
  Description of Artificial Sequence: Synthetic oligonucleotide
agggaattttaggatttgtgtt

SEQ ID NO: 2426 - DNA, 26 bp, Artificial Sequence
  Description of Artificial Sequence: Synthetic oligonucleotide
agggaattttaggatttgtgttcacg

SEQ ID NO: 2427 - DNA, 30 bp, Artificial Sequence
  Description of Artificial Sequence: Synthetic oligonucleotide
agggaattttaggatttgtgttcacgctca

SEQ ID NO: 2428 - DNA, 34 bp, Artificial Sequence
  Description of Artificial Sequence: Synthetic oligonucleotide
agggaattttaggatttgtgttcacgctcaccgt

SEQ ID NO: 2429 - DNA, 38 bp, Artificial Sequence
  Description of Artificial Sequence: Synthetic oligonucleotide
agggaattttaggatttgtgttcacgctcaccgtgccc

SEQ ID NO: 2430 - DNA, 17 bp, Artificial Sequence
  Description of Artificial Sequence: Synthetic oligonucleotide
atcctaaaattccctta

SEQ ID NO: 2431 - DNA, 21 bp, Artificial Sequence
  Description of Artificial Sequence: Synthetic oligonucleotide
atcctaaaattcccttagtca

SEQ ID NO: 2432 - DNA, 25 bp, Artificial Sequence
  Description of Artificial Sequence: Synthetic oligonucleotide
atcctaaaattcccttagtcagagg

SEQ ID NO: 2433 - DNA, 29 bp, Artificial Sequence
  Description of Artificial Sequence: Synthetic oligonucleotide
atcctaaaattcccttagtcagaggtgac

SEQ ID NO: 2434 - DNA, 33 bp, Artificial Sequence
  Description of Artificial Sequence: Synthetic oligonucleotide
atcctaaaattcccttagtcagaggtgacaaga

SEQ ID NO: 2435 - DNA, 37 bp, Artificial Sequence
  Description of Artificial Sequence: Synthetic oligonucleotide
atcctaaaattcccttagtcagaggtgacaagattgg

SEQ ID NO: 2436 - DNA, 33 bp, Artificial Sequence
  Description of Artificial Sequence: Synthetic oligonucleotide
atcttgtcacctctgactaagggaattttagga

SEQ ID NO: 2437 - DNA, 37 bp, Artificial Sequence
  Description of Artificial Sequence: Synthetic oligonucleotide
atcttgtcacctctgactaagggaattttaggatttg

SEQ ID NO: 2438 - DNA, 15 bp, Artificial Sequence
  Description of Artificial Sequence: Synthetic oligonucleotide
caaatcctaaaattc

SEQ ID NO: 2439 - DNA, 19 bp, Artificial Sequence
  Description of Artificial Sequence: Synthetic oligonucleotide
caaatcctaaaattccctt

SEQ ID NO: 2440 - DNA, 23 bp, Artificial Sequence
  Description of Artificial Sequence: Synthetic oligonucleotide
caaatcctaaaattcccttagtc

SEQ ID NO: 2441 - DNA, 27 bp, Artificial Sequence
  Description of Artificial Sequence: Synthetic oligonucleotide
caaatcctaaaattcccttagtcagag

SEQ ID NO: 2442 - DNA, 31 bp, Artificial Sequence
  Description of Artificial Sequence: Synthetic oligonucleotide
caaatcctaaaattcccttagtcagaggtga

SEQ ID NO: 2443 - DNA, 35 bp, Artificial Sequence
  Description of Artificial Sequence: Synthetic oligonucleotide
caaatcctaaaattcccttagtcagaggtgacaag

SEQ ID NO: 2444 - DNA, 39 bp, Artificial Sequence
  Description of Artificial Sequence: Synthetic oligonucleotide
caaatcctaaaattcccttagtcagaggtgacaagattg

SEQ ID NO: 2445 - DNA, 37 bp, Artificial Sequence
  Description of Artificial Sequence: Synthetic oligonucleotide
caatcttgtcacctctgactaagggaattttaggatt

SEQ ID NO: 2446 - DNA, 16 bp, Artificial Sequence
  Description of Artificial Sequence: Synthetic oligonucleotide
cacaaatcctaaaatt

SEQ ID NO: 2447 - DNA, 20 bp, Artificial Sequence
  Description of Artificial Sequence: Synthetic oligonucleotide
cacaaatcctaaaattccct

SEQ ID NO: 2448 - DNA, 24 bp, Artificial Sequence
  Description of Artificial Sequence: Synthetic oligonucleotide
cacaaatcctaaaattcccttagt

SEQ ID NO: 2449 - DNA, 28 bp, Artificial Sequence
  Description of Artificial Sequence: Synthetic oligonucleotide
cacaaatcctaaaattcccttagtcaga

SEQ ID NO: 2450 - DNA, 32 bp, Artificial Sequence
  Description of Artificial Sequence: Synthetic oligonucleotide
cacaaatcctaaaattcccttagtcagaggtg

SEQ ID NO: 2451 - DNA, 36 bp, Artificial Sequence
  Description of Artificial Sequence: Synthetic oligonucleotide
cacaaatcctaaaattcccttagtcagaggtgacaa

SEQ ID NO: 2452 - DNA, 40 bp, Artificial Sequence
  Description of Artificial Sequence: Synthetic oligonucleotide
cacaaatcctaaaattcccttagtcagaggtgacaagatt

SEQ ID NO: 2453 - DNA, 29 bp, Artificial Sequence
  Description of Artificial Sequence: Synthetic oligonucleotide
cacctctgactaagggaattttaggattt

SEQ ID NO: 2454 - DNA, 33 bp, Artificial Sequence
  Description of Artificial Sequence: Synthetic oligonucleotide
cacctctgactaagggaattttaggatttgtgt

SEQ ID NO: 2455 - DNA, 37 bp, Artificial Sequence
  Description of Artificial Sequence: Synthetic oligonucleotide
cacctctgactaagggaattttaggatttgtgttcac

SEQ ID NO: 2456 - DNA, 31 bp, Artificial Sequence
  Description of Artificial Sequence: Synthetic oligonucleotide
cacggtgagcgtgaacacaaatcctaaaatt

SEQ ID NO: 2457 - DNA, 35 bp, Artificial Sequence
  Description of Artificial Sequence: Synthetic oligonucleotide
cacggtgagcgtgaacacaaatcctaaaattccct

SEQ ID NO: 2458 - DNA, 39 bp, Artificial Sequence
  Description of Artificial Sequence: Synthetic oligonucleotide
cacggtgagcgtgaacacaaatcctaaaattcccttagt

SEQ ID NO: 2459 - DNA, 38 bp, Artificial Sequence
  Description of Artificial Sequence: Synthetic oligonucleotide
ccaatcttgtcacctctgactaagggaattttaggatt

SEQ ID NO: 2460 - DNA, 25 bp, Artificial Sequence
  Description of Artificial Sequence: Synthetic oligonucleotide
cctctgactaagggaattttaggat

SEQ ID NO: 2461 - DNA, 29 bp, Artificial Sequence
  Description of Artificial Sequence: Synthetic oligonucleotide
cctctgactaagggaattttaggatttgt

SEQ ID NO: 2462 - DNA, 33 bp, Artificial Sequence
  Description of Artificial Sequence: Synthetic oligonucleotide
cctctgactaagggaattttaggatttgtgttc

SEQ ID NO: 2463 - DNA, 37 bp, Artificial Sequence
  Description of Artificial Sequence: Synthetic oligonucleotide
cctctgactaagggaattttaggatttgtgttcacgc

SEQ ID NO: 2464 - DNA, 29 bp, Artificial Sequence
  Description of Artificial Sequence: Synthetic oligonucleotide
cggtgagcgtgaacacaaatcctaaaatt

SEQ ID NO: 2465 - DNA, 33 bp, Artificial Sequence
  Description of Artificial Sequence: Synthetic oligonucleotide
cggtgagcgtgaacacaaatcctaaaattccct

SEQ ID NO: 2466 - DNA, 37 bp, Artificial Sequence
  Description of Artificial Sequence: Synthetic oligonucleotide
cggtgagcgtgaacacaaatcctaaaattcccttagt

SEQ ID NO: 2467 - DNA, 22 bp, Artificial Sequence
  Description of Artificial Sequence: Synthetic oligonucleotide
cgtgaacacaaatcctaaaatt

SEQ ID NO: 2468 - DNA, 26 bp, Artificial Sequence
  Description of Artificial Sequence: Synthetic oligonucleotide
cgtgaacacaaatcctaaaattccct

SEQ ID NO: 2469 - DNA, 30 bp, Artificial Sequence
  Description of Artificial Sequence: Synthetic oligonucleotide
cgtgaacacaaatcctaaaattcccttagt

SEQ ID NO: 2470 - DNA, 34 bp, Artificial Sequence
  Description of Artificial Sequence: Synthetic oligonucleotide
cgtgaacacaaatcctaaaattcccttagtcaga

SEQ ID NO: 2471 - DNA, 38 bp, Artificial Sequence
  Description of Artificial Sequence: Synthetic oligonucleotide
cgtgaacacaaatcctaaaattcccttagtcagaggtg

SEQ ID NO: 2472 - DNA, 18 bp, Artificial Sequence
  Description of Artificial Sequence: Synthetic oligonucleotide
ctaagggaattttaggat

SEQ ID NO: 2473 - DNA, 22 bp, Artificial Sequence
  Description of Artificial Sequence: Synthetic oligonucleotide
ctaagggaattttaggatttgt

SEQ ID NO: 2474 - DNA, 26 bp, Artificial Sequence
  Description of Artificial Sequence: Synthetic oligonucleotide
ctaagggaattttaggatttgtgttc

SEQ ID NO: 2475 - DNA, 30 bp, Artificial Sequence
  Description of Artificial Sequence: Synthetic oligonucleotide
ctaagggaattttaggatttgtgttcacgc

SEQ ID NO: 2476 - DNA, 34 bp, Artificial Sequence
  Description of Artificial Sequence: Synthetic oligonucleotide
ctaagggaattttaggatttgtgttcacgctcac

SEQ ID NO: 2477 - DNA, 38 bp, Artificial Sequence
  Description of Artificial Sequence: Synthetic oligonucleotide
ctaagggaattttaggatttgtgttcacgctcaccgtg

SEQ ID NO: 2478 - DNA, 24 bp, Artificial Sequence
  Description of Artificial Sequence: Synthetic oligonucleotide
ctctgactaagggaattttaggat

SEQ ID NO: 2479 - DNA, 28 bp, Artificial Sequence
  Description of Artificial Sequence: Synthetic oligonucleotide
ctctgactaagggaattttaggatttgt

SEQ ID NO: 2480 - DNA, 32 bp, Artificial Sequence
  Description of Artificial Sequence: Synthetic oligonucleotide
ctctgactaagggaattttaggatttgtgttc

SEQ ID NO: 2481 - DNA, 36 bp, Artificial Sequence
  Description of Artificial Sequence: Synthetic oligonucleotide
ctctgactaagggaattttaggatttgtgttcacgc

SEQ ID NO: 2482 - DNA, 40 bp, Artificial Sequence
  Description of Artificial Sequence: Synthetic oligonucleotide
ctctgactaagggaattttaggatttgtgttcacgctcac

SEQ ID NO: 2483 - DNA, 24 bp, Artificial Sequence
  Description of Artificial Sequence: Synthetic oligonucleotide
ctgactaagggaattttaggattt

SEQ ID NO: 2484 - DNA, 28 bp, Artificial Sequence
  Description of Artificial Sequence: Synthetic oligonucleotide
ctgactaagggaattttaggatttgtgt

SEQ ID NO: 2485 - DNA, 32 bp, Artificial Sequence
  Description of Artificial Sequence: Synthetic oligonucleotide
ctgactaagggaattttaggatttgtgttcac

SEQ ID NO: 2486 - DNA, 36 bp, Artificial Sequence
  Description of Artificial Sequence: Synthetic oligonucleotide
ctgactaagggaattttaggatttgtgttcacgctc

SEQ ID NO: 2487 - DNA, 40 bp, Artificial Sequence
  Description of Artificial Sequence: Synthetic oligonucleotide
ctgactaagggaattttaggatttgtgttcacgctcaccg

SEQ ID NO: 2488 - DNA, 33 bp, Artificial Sequence
  Description of Artificial Sequence: Synthetic oligonucleotide
cttgtcacctctgactaagggaattttaggatt

SEQ ID NO: 2489 - DNA, 37 bp, Artificial Sequence
  Description of Artificial Sequence: Synthetic oligonucleotide
cttgtcacctctgactaagggaattttaggatttgtg

SEQ ID NO: 2490 - DNA, 16 bp, Artificial Sequence
  Description of Artificial Sequence: Synthetic oligonucleotide
taagggaattttagga

SEQ ID NO: 2491 - DNA, 20 bp, Artificial Sequence
  Description of Artificial Sequence: Synthetic oligonucleotide
taagggaattttaggatttg

SEQ ID NO: 2492 - DNA, 24 bp, Artificial Sequence
  Description of Artificial Sequence: Synthetic oligonucleotide
taagggaattttaggatttgtgtt

SEQ ID NO: 2493 - DNA, 28 bp, Artificial Sequence
  Description of Artificial Sequence: Synthetic oligonucleotide
taagggaattttaggatttgtgttcacg

SEQ ID NO: 2494 - DNA, 32 bp, Artificial Sequence
  Description of Artificial Sequence: Synthetic oligonucleotide
taagggaattttaggatttgtgttcacgctca

SEQ ID NO: 2495 - DNA, 36 bp, Artificial Sequence
  Description of Artificial Sequence: Synthetic oligonucleotide
taagggaattttaggatttgtgttcacgctcaccgt

SEQ ID NO: 2496 - DNA, 40 bp, Artificial Sequence
  Description of Artificial Sequence: Synthetic oligonucleotide
taagggaattttaggatttgtgttcacgctcaccgtgccc

SEQ ID NO: 2497 - DNA, 30 bp, Artificial Sequence
  Description of Artificial Sequence: Synthetic oligonucleotide
tcacctctgactaagggaattttaggattt

SEQ ID NO: 2498 - DNA, 34 bp, Artificial Sequence
  Description of Artificial Sequence: Synthetic oligonucleotide
tcacctctgactaagggaattttaggatttgtgt

SEQ ID NO: 2499 - DNA, 38 bp, Artificial Sequence
  Description of Artificial Sequence: Synthetic oligonucleotide
tcacctctgactaagggaattttaggatttgtgttcac

SEQ ID NO: 2500 - DNA, 14 bp, Artificial Sequence
  Description of Artificial Sequence: Synthetic oligonucleotide
tcctaaaattccct

SEQ ID NO: 2501 - DNA, 18 bp, Artificial Sequence
  Description of Artificial Sequence: Synthetic oligonucleotide
tcctaaaattcccttagt

SEQ ID NO: 2502 - DNA, 22 bp, Artificial Sequence
  Description of Artificial Sequence: Synthetic oligonucleotide
tcctaaaattcccttagtcaga

SEQ ID NO: 2503 - DNA, 26 bp, Artificial Sequence
  Description of Artificial Sequence: Synthetic oligonucleotide
tcctaaaattcccttagtcagaggtg

SEQ ID NO: 2504 - DNA, 30 bp, Artificial Sequence
  Description of Artificial Sequence: Synthetic oligonucleotide
tcctaaaattcccttagtcagaggtgacaa

SEQ ID NO: 2505 - DNA, 34 bp, Artificial Sequence
  Description of Artificial Sequence: Synthetic oligonucleotide
tcctaaaattcccttagtcagaggtgacaagatt

SEQ ID NO: 2506 - DNA, 38 bp, Artificial Sequence
  Description of Artificial Sequence: Synthetic oligonucleotide
tcctaaaattcccttagtcagaggtgacaagattggtc

SEQ ID NO: 2507 - DNA, 23 bp, Artificial Sequence
  Description of Artificial Sequence: Synthetic oligonucleotide
tctgactaagggaattttaggat

SEQ ID NO: 2508 - DNA, 27 bp, Artificial Sequence
  Description of Artificial Sequence: Synthetic oligonucleotide
tctgactaagggaattttaggatttgt

SEQ ID NO: 2509 - DNA, 31 bp, Artificial Sequence
  Description of Artificial Sequence: Synthetic oligonucleotide
tctgactaagggaattttaggatttgtgttc

SEQ ID NO: 2510 - DNA, 35 bp, Artificial Sequence
  Description of Artificial Sequence: Synthetic oligonucleotide
tctgactaagggaattttaggatttgtgttcacgc

SEQ ID NO: 2511 - DNA, 39 bp, Artificial Sequence
  Description of Artificial Sequence: Synthetic oligonucleotide
tctgactaagggaattttaggatttgtgttcacgctcac

SEQ ID NO: 2512 - DNA, 34 bp, Artificial Sequence
  Description of Artificial Sequence: Synthetic oligonucleotide
tcttgtcacctctgactaagggaattttaggatt

SEQ ID NO: 2513 - DNA, 38 bp, Artificial Sequence
  Description of Artificial Sequence: Synthetic oligonucleotide
tcttgtcacctctgactaagggaattttaggatttgtg

SEQ ID NO: 2514 - DNA, 21 bp, Artificial Sequence
  Description of Artificial Sequence: Synthetic oligonucleotide
tgaacacaaatcctaaaattc

SEQ ID NO: 2515 - DNA, 25 bp, Artificial Sequence
  Description of Artificial Sequence: Synthetic oligonucleotide
tgaacacaaatcctaaaattccctt

SEQ ID NO: 2516 - DNA, 29 bp, Artificial Sequence
  Description of Artificial Sequence: Synthetic oligonucleotide
tgaacacaaatcctaaaattcccttagtc

SEQ ID NO: 2517 - DNA, 33 bp, Artificial Sequence
  Description of Artificial Sequence: Synthetic oligonucleotide
tgaacacaaatcctaaaattcccttagtcagag

SEQ ID NO: 2518 - DNA, 37 bp, Artificial Sequence
  Description of Artificial Sequence: Synthetic oligonucleotide
tgaacacaaatcctaaaattcccttagtcagaggtga

SEQ ID NO: 2519 - DNA, 20 bp, Artificial Sequence
  Description of Artificial Sequence: Synthetic oligonucleotide
tgactaagggaattttagga

SEQ ID NO: 2520 - DNA, 24 bp, Artificial Sequence
  Description of Artificial Sequence: Synthetic oligonucleotide
tgactaagggaattttaggatttg

SEQ ID NO: 2521 - DNA, 28 bp, Artificial Sequence
  Description of Artificial Sequence: Synthetic oligonucleotide
tgactaagggaattttaggatttgtgtt

SEQ ID NO: 2522 - DNA, 32 bp, Artificial Sequence
  Description of Artificial Sequence: Synthetic oligonucleotide
tgactaagggaattttaggatttgtgttcacg

SEQ ID NO: 2523 - DNA, 36 bp, Artificial Sequence
  Description of Artificial Sequence: Synthetic oligonucleotide
tgactaagggaattttaggatttgtgttcacgctca

SEQ ID NO: 2524 - DNA, 40 bp, Artificial Sequence
  Description of Artificial Sequence: Synthetic oligonucleotide
tgactaagggaattttaggatttgtgttcacgctcaccgt

SEQ ID NO: 2525 - DNA, 29 bp, Artificial Sequence
  Description of Artificial Sequence: Synthetic oligonucleotide
tgagcgtgaacacaaatcctaaaattccc

SEQ ID NO: 2526 - DNA, 33 bp, Artificial Sequence
  Description of Artificial Sequence: Synthetic oligonucleotide
tgagcgtgaacacaaatcctaaaattcccttag

SEQ ID NO: 2527 - DNA, 37 bp, Artificial Sequence
  Description of Artificial Sequence: Synthetic oligonucleotide
tgagcgtgaacacaaatcctaaaattcccttagtcag

SEQ ID NO: 2528 - DNA, 35 bp, Artificial Sequence
  Description of Artificial Sequence: Synthetic oligonucleotide
tgggcacggtgagcgtgaacacaaatcctaaaatt

SEQ ID NO: 2529 - DNA, 32 bp, Artificial Sequence
  Description of Artificial Sequence: Synthetic oligonucleotide
tgtcacctctgactaagggaattttaggattt

SEQ ID NO: 2530 - DNA, 36 bp, Artificial Sequence
  Description of Artificial Sequence: Synthetic oligonucleotide
tgtcacctctgactaagggaattttaggatttgtgt

SEQ ID NO: 2531 - DNA, 40 bp, Artificial Sequence
  Description of Artificial Sequence: Synthetic oligonucleotide
tgtcacctctgactaagggaattttaggatttgtgttcac

SEQ ID NO: 2532 - DNA, 33 bp, Artificial Sequence
  Description of Artificial Sequence: Synthetic oligonucleotide
ttgtcacctctgactaagggaattttaggattt

SEQ ID NO: 2533 - DNA, 37 bp, Artificial Sequence
  Description of Artificial Sequence: Synthetic oligonucleotide
ttgtcacctctgactaagggaattttaggatttgtgt

SEQ ID NO: 2534-2543 - skipped (10 entries)

SEQ ID NO: 2544 - DNA, 20 bp, Artificial Sequence
  Description of Artificial Sequence: Synthetic oligonucleotide
gaccccaaaatcagcgaaat

SEQ ID NO: 2545 - DNA, 24 bp, Artificial Sequence
  Description of Artificial Sequence: Synthetic oligonucleotide
tctggttactgccagttgaatctg

SEQ ID NO: 2546 - DNA, 24 bp, Artificial Sequence
  Description of Artificial Sequence: Synthetic oligonucleotide
accccgcattacgtttggtggacc

SEQ ID NO: 2547 - DNA, 15 bp, Artificial Sequence
  Description of Artificial Sequence: Synthetic oligonucleotide
tacgtttggtggacc

SEQ ID NO: 2548 - DNA, 20 bp, Artificial Sequence
  Description of Artificial Sequence: Synthetic oligonucleotide
ttacaaacattggccgcaaa

SEQ ID NO: 2549 - DNA, 18 bp, Artificial Sequence
  Description of Artificial Sequence: Synthetic oligonucleotide
gcgcgacattccgaagaa

SEQ ID NO: 2550 - DNA, 23 bp, Artificial Sequence
  Description of Artificial Sequence: Synthetic oligonucleotide
acaatttgcccccagcgcttcag

SEQ ID NO: 2551 - DNA, 14 bp, Artificial Sequence
  Description of Artificial Sequence: Synthetic oligonucleotide
ccccagcgcttcag

SEQ ID NO: 2552 - DNA, 19 bp, Artificial Sequence
  Description of Artificial Sequence: Synthetic oligonucleotide
agatttggacctgcgagcg

SEQ ID NO: 2553 - DNA, 20 bp, Artificial Sequence
  Description of Artificial Sequence: Synthetic oligonucleotide
gagcggctgtctccacaagt

SEQ ID NO: 2554 - DNA, 23 bp, Artificial Sequence
  Description of Artificial Sequence: Synthetic oligonucleotide
ttctgacctgaaggctctgcgcg

SEQ ID NO: 2555 - DNA, 14 bp, Artificial Sequence
  Description of Artificial Sequence: Synthetic oligonucleotide
gaaggctctgcgcg

SEQ ID NO: 2556 - DNA, 23 bp, Artificial Sequence
  Description of Artificial Sequence: Synthetic oligonucleotide
ttctgacctgaaggctctgcgcg

What is claimed is:

1. A composition for amplifying three different target sequences in the SARS-CoV-2 genome, comprising:
   (a) a first forward primer and a first reverse primer configured to amplify a first target sequence present in a first target region of the SARS-CoV-2 genome, wherein the first target sequence includes at least 10 contiguous nucleotides of the first target region;
   (b) a second forward primer and a second reverse primer configured to amplify a second target sequence present in a second target region of the SARS-CoV-2 genome, wherein the second target sequence includes at least 10 contiguous nucleotides of the second target region; and
   (c) a third forward primer and a third reverse primer configured to amplify a third target sequence present in a third target region of the SARS-CoV-2 genome, wherein the third target sequence includes at least 10 contiguous nucleotides of the third target region;
   wherein the first, second and third target regions each have less than 50% similarity with an analogous region in bat-SL-CoVZC45.

2. The composition of claim 1, wherein the first target region is SEQ ID NO: 1.

3. The composition of claim 1, wherein the second target region is SEQ ID NO: 2.

4. The composition of claim 1, wherein the third target region is SEQ ID NO: 3.

5. The composition of claim 1, wherein the first target region is within the N gene of SARS-CoV-2.

6. The composition of claim 1, wherein the second target region is within the S gene of SARS-CoV-2.

7. The composition of claim 1, wherein the third target region is within the ORF1ab gene of SARS-CoV-2.

8. The composition of claim 1, further including a nucleic acid sample, a polymerase, a buffer and nucleotides.

9. The composition of claim 1, further including a first probe containing a first label that is a fluorescent or other detectable label.

10. The composition of claim 9, wherein the first label of the first probe is a fluorescent label and the probe further includes a quencher that quenches the fluorescent label.

11. The composition of claim 9, further including a second probe including a second fluorescent label and a third probe including a third fluorescent label.

12. The composition of claim 1, wherein the first forward primer and the first reverse primer are selected from SEQ ID NOs: 248 and 487, or 211 and 501 or 510.

13. The composition of claim 1, wherein the second forward primer and the second reverse primer are selected from SEQ ID NOs: 5 and 441, or 100 and 337.

14. The composition of claim 1, wherein the third forward primer and the third reverse primer are selected from SEQ ID NOs: 4 and 320, or 34 and 423, or 160 and 468.

15. The composition of claim 1, further including a positive control for amplification, wherein the positive control is a synthetic plasmid comprising target regions from the SARS-CoV-2 ORF1ab gene, the S protein gene and the N protein gene.

16. A method for detecting SARS-CoV-2 in a biological sample, comprising:
(a) providing a reaction mixture containing at least a portion of the biological sample and the composition of claim 1;
(b) subjecting the reaction mixture to amplification conditions, thereby forming one or more amplification products; and
(c) detecting at least one of the amplification products.

* * * * *